(12) United States Patent
Pizza et al.

(10) Patent No.: US 8,062,644 B2
(45) Date of Patent: Nov. 22, 2011

(54) IMMUNOGENS FROM UROPATHOGENIC *ESCHERICHIA COLI*

(75) Inventors: Mariagrazia Pizza, Siena (IT); Laura Serino, Monticiano (IT); Francesco Berlanda Scorza, Trento (IT); Danilo Gomes Moriel, Monteriggioni (IT); Maria Rita Fontana, Siena (IT)

(73) Assignee: Novartis Vaccines & Diagnostics SRL., Siena (IT)

( * ) Notice: Subject to any disclaimer, the term of this patent is extended or adjusted under 35 U.S.C. 154(b) by 788 days.

(21) Appl. No.: 11/884,825

(22) PCT Filed: Feb. 17, 2006

(86) PCT No.: PCT/US2006/005912
§ 371 (c)(1),
(2), (4) Date: Apr. 4, 2008

(87) PCT Pub. No.: WO2006/091517
PCT Pub. Date: Aug. 31, 2006

(65) Prior Publication Data
US 2009/0324633 A1    Dec. 31, 2009

Related U.S. Application Data

(60) Provisional application No. 60/654,632, filed on Feb. 18, 2005.

(51) Int. Cl.
*A61K 39/108* (2006.01)
*A61K 39/00* (2006.01)
*A61K 39/02* (2006.01)

(52) U.S. Cl. .............. 424/241.1; 424/184.1; 424/185.1; 424/234.1; 424/242.1; 424/257.1

(58) Field of Classification Search .................. None
See application file for complete search history.

(56) References Cited

U.S. PATENT DOCUMENTS
2003/0165870 A1    9/2003    Blattner et al.

FOREIGN PATENT DOCUMENTS
WO    WO-03/074553 A2    9/2003
WO    WO-2006/046143 A2    5/2006

OTHER PUBLICATIONS

Welch et al (UniProt integrated Mar. 1, 2003, GeneBank Accession No. AE014075).*
Welch et al (Proc. Natl. Acad. Sci. U.S.A. 99:107020-1024, 2002).*
Bowie et al (Science, 1990, 257:1306-1310).*
Greenspan et al (Nature Biotechnology 7: 936-937, 1999).*
Boslego et al (Vaccines and Immunotherapy, Pergaman Press, 1991, Chapter 17, 221-223).*
Ellis (Vaccines, W.B. Saunders Company, 1988, Chapter 29, 568-575).*
Greenspan et al. (Nature Biotechnology 7: 936-937, 1999).*
Database EBI Accession No. Q8CWD4__ECOL6, last updated Jun. 10, 2008, located at <http://beta.uniprot.org/uniprot/Q8CWD4.txt>, last visited on Jun. 16, 2008, 2 pages.
International Search Report mailed on Dec. 13, 2006, for PCT Patent Application No. PCT/US2006/005912 filed on Feb. 17, 2006, 5 pages.
Welch, R. et al. (Dec. 24, 2002). "Extensive Mosaic Structure Revealed by Complete Genome Sequence of Uropathogenic *Escherichia Coli,*" *Proceedings of the National Academy of Sciences of USA* 99(26):17020-17024.
Database EBI Accession No. Q8FAG2. Mar. 1, 2003. 2 pages.
European Search Report dated Mar. 13, 2009, for EP Patent Application No. 06748227. 4 pages.

* cited by examiner

*Primary Examiner* — Vanessa L. Ford
(74) *Attorney, Agent, or Firm* — Robert Gorman

(57) ABSTRACT

Disclosed herein are various genes that can be included in immunogenic compositions specific for pathogenic *E. coli* strains. The genes are from uropathogenic strains but are absent from non-pathogenic strains, and their encoded proteins have cellular locations which render them accessible to the immune system.

8 Claims, 1 Drawing Sheet

IMMUNOGENS FROM UROPATHOGENIC ESCHERICHIA COLI

RELATED APPLICATION

This application claims the benefit of U.S. Provisional Application No. 60/654,632, filed Feb. 18, 2005, which teachings are incorporated herein in their entirety by reference.

All documents cited herein are incorporated by reference in their entirety.

TECHNICAL FIELD

This invention is in the field of *Escherichia coli* biology, and in particular relates to immunogens for use in immunizing against extraintestinal pathogenic *E. coli* (ExPEC) strains.

BACKGROUND ART

Few microorganisms are as versatile as *E. coli*. As well as being an important member of the normal intestinal microflora of mammals, it has been widely exploited as a host in recombinant DNA technology. In addition, however, *E. coli* can also be a deadly pathogen.

*E. coli* strains have traditionally been classified as either commensal or pathogenic, and pathogenic strains are then sub-classified as intestinal or extraintestinal strains. More recent taxonomic techniques such as multilocus enzyme electrophoresis (MLEE) classify *E. coli* into five phylogenetic groups (A, B1, B2, D & E), and these groupings do not match the traditional ones. For instance, MLEE group B1 includes both commensal and pathogenic strains, and group D includes both intestinal and extraintestinal strains.

The extraintestinal pathogenic strains (or 'ExPEC' strains [1]) of *E. coli* fall into MLEE groups B2 and D, and include both uropathogenic (UPEC) strains and meningitis/sepsis-associated (MNEC) strains. UPEC strains cause urinary tract infections (UTIs), and are the most common form of cystitis. They also cause pyelonephritis (and its complications such as sepsis) and catheter-associated infections. MNEC strains cause neonatal meningitis (0.1 cases per 1000 live births) with case fatality rates ranging from 25 to 40%, and are also responsible for around ⅙ of sepsis cases.

Most previous ExPEC vaccines have been based on cell lysates or on cellular structures. SOLCOUROVAC™ includes ten different heat-killed bacteria including six ExPEC strains, and a successful phase II clinical trial was reported in reference 2. URO-VAXOM™ is an oral tablet vaccine containing lyophilized bacterial lysates of 18 selected *E. coli* strains [3]. Baxter Vaccines developed a UTI vaccine based on pili from 6 to 10 different strains, but this product has been abandoned. MedImmune developed a product called MEDI 516 based on the FimH adhesin complex [4], but phase II clinical trials shows inadequate efficacy. Moreover, there was a risk with this vaccine that it would also affect non-pathogenic FimH$^{+ve}$ strains in the normal intestinal flora, and it was expected that this vaccine would be effective against UPEC strains only, because of its bladder-specific adherence mechanism, leaving other ExPEC strains uncontrolled.

There is thus a need for improved ExPEC vaccines, including a need to move away from crude cell lysates and towards better-defined molecules, and a need to identify further antigens that are suitable for inclusion in vaccines, particularly antigens that are prevalent among clinical ExPEC strains without also being found in commensal strains.

One way of addressing these needs was reported in reference 5, where the inventors looked for genes present in genomes of MLEE types B2 and D but absent from MLEE types A and B1. Further comparative approaches, based on subtractive hybridization, were reported in references 6 and 7. Virulence genes in ExPEC strains have also been identified in reference 8. Reference 9 discloses an analysis of four pathogenicity islands in UPEC *E. coli* strain 536.

Reference 10 used the genome sequence of UPEC (O6:K2:H1) strain CFT073 [11,12] to identify sequences not present in non-pathogenic *E. coli* strains. Reference 13 discloses a comparison of the genome sequence of *E. coli* human pyelonephritis isolate 536 (O6:K15:H31), an UPEC, with sequence data for strains CFT073 (UPEC), EDL933 (enterohemorrhagic) and MG1655 (non-pathogenic laboratory strain). Genome sequences of pathogenic strains are available in the databases under accession numbers AE005174, BA000007 and NC-004431. A sequence from a non-pathogenic strain is available under accession number U00096.

It is an object of the invention to provide further antigens for use in immunization against pathogenic *E. coli* strains, particularly ExPEC strains, and more particularly UPEC strains.

SUMMARY OF THE INVENTION

The inventors have identified various genes that can be included in immunogenic compositions specific for pathogenic *E. coli* strains. The genes are from uropathogenic strains (UPEC) but are absent from non-pathogenic strains, and their encoded proteins have cellular locations which render them accessible to the immune system.

In one aspect, the invention relates to a polypeptide comprising: (a) an amino acid sequence selected from the group consisting of SEQ ID NOs 22, 1, 2, 3, 4, 5, 6, 7, 8, 9, 10, 11, 12, 13, 14, 15, 16, 17, 18, 19, 20, 21, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598 and 599; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, polypeptides of this aspect of the invention comprise a fragment which comprises at least one B-cell epitope of (a).

In another aspect, the invention relates to a polypeptide comprising: (a) an amino acid sequence selected from the group consisting of SEQ ID NOs 22, 120, 219, 221, 305, 371, 400, 489, 555, 565, 597, 598 and 599; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, polypeptides of this aspect of the invention comprise a fragment which comprises at least one B-cell epitope of (a).

The polypeptides of the invention can be used in medicine and in the manufacture of a medicament for raising an immune response in a patient.

The present invention also relates to a pharmaceutical composition comprising a polypeptide of the invention in admixture with a pharmaceutically acceptable carrier. The invention further relates to a pharmaceutical composition comprising two or more polypeptides of the invention in admixture with a pharmaceutically acceptable carrier. In a particular embodiment, the pharmaceutical compositions of the invention further comprise a vaccine adjuvant.

The present invention further relates to immunogenic compositions comprising one or more outer membrane vesicles (OMVs) expressing or overexpressing one or more polypeptides comprising: (a) an amino acid sequence selected from the group consisting of SEQ ID NOs 22, 120, 219, 221, 305, 371, 400, 489, 555, 565, 597, 598 and 599; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, the immunogenic composition of this aspect of the invention comprises one or more polypeptides comprising a fragment which comprises at least one B-cell epitope of (a).

The present invention also relates to methods for raising an immune response in a patient, comprising the step of administering to the patient a pharmaceutical composition or immunogenic composition of the invention. In a particular embodiment, the immune response is protective against ExPEC infection.

Further aspects of the invention are described below.

DETAILED DESCRIPTION OF THE INVENTION

Figure 1:
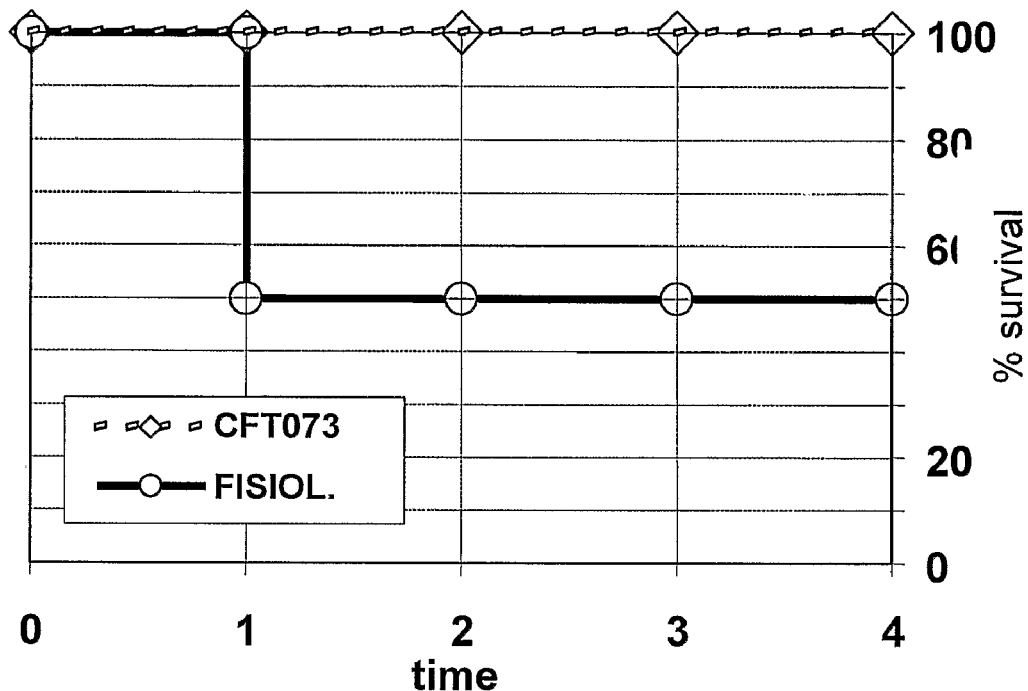
FIG. 1 shows the % survival of mice after challenge with CFT073 following immunization with heat-inactivated CFT073.
Figure 1:
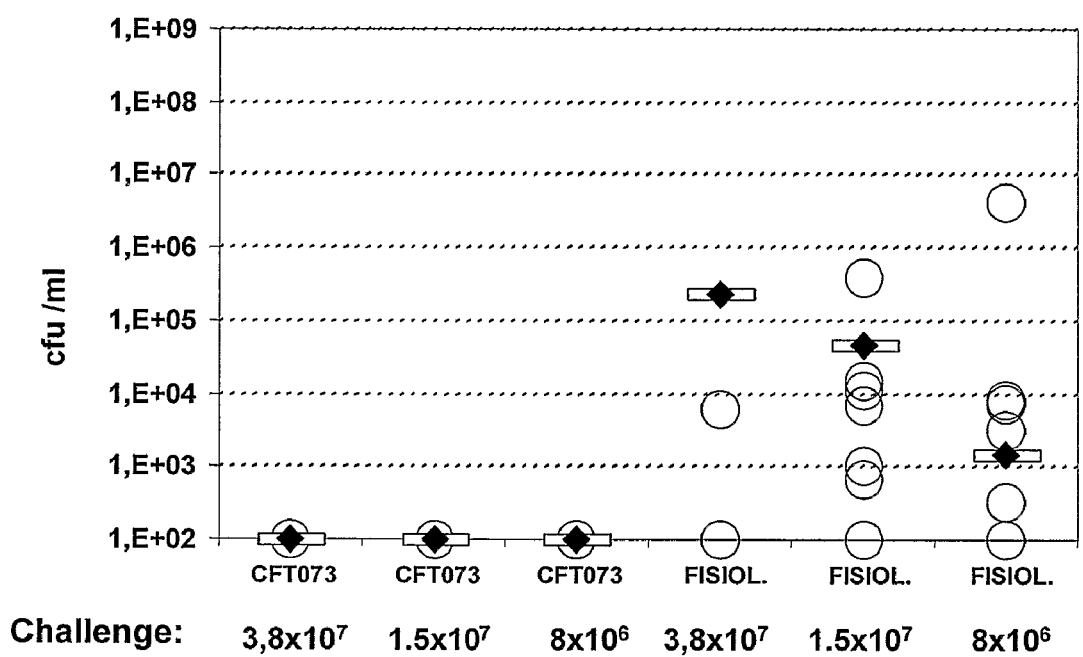

The inventors have identified various genes that can be included in immunogenic compositions specific for pathogenic *E. coli* strains. The genes are from UPEC strains but are absent from non-pathogenic strains, and their encoded proteins have cellular locations which render them accessible to the immune system.

Polypeptides

The invention provides polypeptides comprising the amino acid sequences disclosed in the examples. These amino acid sequences are given in the sequence listing as SEQ ID NOs 1 to 596 and 597 to 599. Preferred subsets of SEQ ID NOs 1 to 596 are given in Tables 2, 3 and 5.

The invention also provides polypeptides comprising amino acid sequences that have sequence identity to the amino acid sequences disclosed in the examples. Depending on the particular sequence, the degree of sequence identity is preferably greater than 50% (e.g. 60%, 70%, 75%, 80%, 85%, 90%, 91%, 92%, 93%, 94%, 95%, 96%, 97%, 98%, 99% or more). These polypeptides include homologs, orthologs, allelic variants and mutants. Typically, 50% identity or more between two polypeptide sequences is considered to be an indication of functional equivalence. Identity between polypeptides is preferably determined by the Smith-Waterman homology search algorithm as implemented in the MPSRCH program (Oxford Molecular), using an affine gap search with parameters gap open penalty=12 and gap extension penalty=1.

These polypeptide may, compared to the sequences of the examples, include one or more (e.g. 1, 2, 3, 4, 5, 6, 7, 8, 9, 10, etc.) conservative amino acid replacements i.e. replacements of one amino acid with another which has a related side chain. Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may have one or more (e.g. 1, 2, 3, 4, 5, 6, 7, 8, 9, 10, etc.) single amino acid deletions relative to a reference sequence. The polypeptides may also include one or more (e.g. 1, 2, 3, 4, 5, 6, 7, 8, 9, 10, etc.) insertions (e.g. each of 1, 2, 3, 4 or 5 amino acids) relative to a reference sequence.

Preferred polypeptides include polypeptides that are lipidated, that are located in the outer membrane, that are located in the inner membrane, or that are located in the periplasm. Particularly preferred polypeptides are those that fall into more than one of these categories e.g. lipidated polypeptides that are located in the outer membrane. Lipoproteins may have a N-terminal cysteine to which lipid is covalently attached, following post-translational processing of the signal peptide.

Polypeptides that may be lipidated include SEQ ID NOS: 1, 2, 7, 12, 13, 14, 15, 16, 17, 18, 22, 26, 28, 29, 33, 34, 38, 40, 45, 50, 51, 59, 67, 68, 69, 71, 77, 80, 82, 83, 84, 92, 98, 103, 104, 105, 120, 121, 124, 125, 126, 127, 130, 131, 133, 134, 138, 142, 147, 159, 160, 176, 184, 185, 186, 187, 192, 206, 210, 215, 222, 223, 225, 226, 228, 233, 234, 246, 251, 252, 268, 272, 273, 275, 284, 287, 293, 295, 297, 298, 299, 300, 302, 303, 304, 305, 310, 311, 312, 314, 315, 320, 326, 327, 330, 331, 336, 340, 359, 360, 364, 366, 367, 369, 370, 371, 374, 378, 379, 386, 387, 388, 389, 390, 395, 400, 401, 407, 408, 418, 419, 422, 423, 425, 429, 431, 433, 434, 435, 436, 438, 441, 442, 444, 447, 453, 464, 465, 472, 478, 492, 500, 506, 509, 517, 518, 519, 523, 526, 531, 536, 540, 543, 544, 546, 548, 551, 557, 559, 560, 562, 563, 564, 565, 566, 568, 569, 574, 577, 583, 584, 585, 586, 593 and 594.

Preferred polypeptides are those listed in Tables 2, 3 and 5, particularly those listed in Table 3.

The invention further provides polypeptides comprising fragments of the amino acid sequences disclosed in the examples. The fragments should comprise at least n consecutive amino acids from the sequences and, depending on the particular sequence, n is 7 or more (e.g. 8, 10, 12, 14, 16, 18, 20, 22, 24, 26, 28, 30, 35, 40, 45, 50, 60, 70, 80, 90, 100 or more). The fragment may comprise at least one T-cell or, preferably, a B-cell epitope of the sequence. T- and B-cell epitopes can be identified empirically (e.g. using PEPSCAN [14,15] or similar methods), or they can be predicted (e.g. using the Jameson-Wolf antigenic index [16], matrix-based approaches [17], TEPITOPE [18], neural networks [19], OptiMer & EpiMer [20,21], ADEPT [22], Tsites [23], hydrophilicity [24], antigenic index [25] or the methods disclosed in reference 26, etc.). Other preferred fragments are (a) the N-terminal signal peptides of the polypeptides of the invention, (b) the polypeptides, but without their N-terminal signal peptides, (c) the polypeptides, but without their N-terminal amino acid residue.

Other preferred fragments are those that begin with an amino acid encoded by a potential start codon (ATG, GTG, TTG). Fragments starting at the methionine encoded by a start codon downstream of the indicated start codon are polypeptides of the invention.

Other preferred fragments are those that are common to a polypeptide of the invention and to a polypeptide identified in any of references 5, 6, 8, 10 and 11.

Polypeptides of the invention can be prepared in many ways e.g. by chemical synthesis (in whole or in part), by digesting longer polypeptides using proteases, by translation from RNA, by purification from cell culture (e.g. from recombinant expression), from the organism itself (e.g. after bacterial culture, or direct from patients), etc. A preferred method for production of peptides <40 amino acids long involves in vitro chemical synthesis [27,28]. Solid-phase peptide synthesis is particularly preferred, such as methods based on tBoc or Fmoc [29] chemistry. Enzymatic synthesis [30] may also be used in part or in full. As an alternative to chemical synthesis, biological synthesis may be used e.g. the polypeptides may be produced by translation. This may be carried out in vitro or in vivo. Biological methods are in general restricted to the production of polypeptides based on L-amino acids, but manipulation of translation machinery (e.g. of aminoacyl tRNA molecules) can be used to allow the introduction of D-amino acids (or of other non natural amino acids, such as iodotyrosine or methylphenylalanine, azidohomoalanine, etc.) [31]. Where D-amino acids are included, however, it is preferred to use chemical synthesis. Polypeptides of the invention may have covalent modifications at the C-terminus and/or N-terminus.

Polypeptides of the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.).

Polypeptides of the invention are preferably provided in purified or substantially purified form i.e. substantially free from other polypeptides (e.g. free from naturally-occurring polypeptides), particularly from other ExPEC or host cell polypeptides, and are generally at least about 50% pure (by weight), and usually at least about 90% pure i.e. less than about 50%, and more preferably less than about 10% (e.g. 5% or less) of a composition is made up of other expressed polypeptides. Polypeptides of the invention are preferably ExPEC polypeptides.

Polypeptides of the invention may be attached to a solid support. Polypeptides of the invention may comprise a detectable label (e.g. a radioactive or fluorescent label, or a biotin label).

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. Polypeptides can occur as single chains or associated chains. Polypeptides of the invention can be naturally or non-naturally glycosylated (i.e. the polypeptide has a glycosylation pattern that differs from the glycosylation pattern found in the corresponding naturally occurring polypeptide).

Polypeptides of the invention may be at least 40 amino acids long (e.g. at least 40, 50, 60, 70, 80, 90, 100, 120, 140, 160, 180, 200, 220, 240, 260, 280, 300, 350, 400, 450, 500 or more). Polypeptides of the invention may be shorter than 500 amino acids (e.g. no longer than 40, 50, 60, 70, 80, 90, 100, 120, 140, 160, 180, 200, 220, 240, 260, 280, 300, 350, 400 or 450 amino acids).

The invention provides polypeptides comprising a sequence -X-Y- or -Y-X-, wherein: -X- is an amino acid sequence as defined above and -Y- is not a sequence as defined above i.e. the invention provides fusion proteins. Where the N-terminus codon of a polypeptide-coding sequence is not ATG then that codon will be translated as the standard amino acid for that codon rather than as a Met, which occurs when the codon is translated as a start codon.

The invention provides a process for producing polypeptides of the invention, comprising the step of culturing a host cell of to the invention under conditions which induce polypeptide expression.

The invention provides a process for producing a polypeptide of the invention, wherein the polypeptide is synthesized in part or in whole using chemical means.

The invention provides a composition comprising two or more polypeptides of the invention.

The invention also provides a hybrid polypeptide represented by the formula NH$_2$-A-[-X-L-]$_n$-B-COOH, wherein X is a polypeptide of the invention as defined above, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, -X- may be the same or different. For each n instances of [-X-L-], linker amino acid sequence -L- may be present or absent. For instance, when n=2 the hybrid may be NH$_2$—X$_1$-L$_1$-X$_2$-L$_2$-COOH, NH$_2$—X$_1$-X$_2$—COOH, NH$_2$—X$_1$-L$_1$-X$_2$—COOH, NH$_2$—X$_1$-X$_2$-L$_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. -A- and -B- are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct polypeptide trafficking, or short peptide sequences which facilitate cloning or purification (e.g. histidine tags i.e. His$_n$ where n=3, 4, 5, 6, 7, 8, 9, 10 or more). Other suitable N-terminal and C-terminal amino acid sequences will be apparent to those skilled in the art.

Various tests can be used to assess the in vivo immunogenicity of polypeptides of the invention. For example, polypeptides can be expressed recombinantly and used to screen patient sera by immunoblot. A positive reaction between the polypeptide and patient serum indicates that the patient has previously mounted an immune response to the protein in question i.e. the protein is an immunogen. This method can also be used to identify immunodominant proteins.

Antibodies

The invention provides antibodies that bind to polypeptides of the invention. These may be polyclonal or monoclonal and may be produced by any suitable means (e.g. by recombinant expression). To increase compatibility with the human immune system, the antibodies may be chimeric or humanized [e.g. refs. 32 & 33], or fully human antibodies may be used. The antibodies may include a detectable label (e.g. for diagnostic assays). Antibodies of the invention may be attached to a solid support. Antibodies of the invention are preferably neutralizing antibodies.

Monoclonal antibodies are particularly useful in identification and purification of the individual polypeptides against which they are directed. Monoclonal antibodies of the invention may also be employed as reagents in immunoassays, radioimmunoassays (RIA) or enzyme-linked immunosorbent assays (ELISA), etc. In these applications, the antibodies can be labeled with an analytically-detectable reagent such as a radioisotope, a fluorescent molecule or an enzyme. The monoclonal antibodies produced by the above method may also be used for the molecular identification and characterization (epitope mapping) of polypeptides of the invention.

Antibodies of the invention are preferably specific to ExPEC strains of E. coli, i.e. they bind preferentially to ExPEC E. coli relative to other bacteria (e.g. relative to non-ExPEC E. coli and relative to non-E. coli bacteria). More preferably, the antibodies are specific to UPEC strains i.e. they bind preferentially to UPEC bacteria relative to other bacteria, including other ExPEC E. coli.

Antibodies of the invention are preferably provided in purified or substantially purified form. Typically, the antibody will be present in a composition that is substantially free of other polypeptides e.g. where less than 90% (by weight), usually less than 60% and more usually less than 50% of the composition is made up of other polypeptides.

Antibodies of the invention can be of any isotype (e.g. IgA, IgG, IgM i.e. an α, γ or μ heavy chain), but will generally be IgG. Within the IgG isotype, antibodies may be IgG1, IgG2, IgG3 or IgG4 subclass. Antibodies of the invention may have a κ or a λ light chain.

Antibodies of the invention can take various forms, including whole antibodies, antibody fragments such as F(ab')$_2$ and F(ab) fragments, Fv fragments (non-covalent heterodimers), single-chain antibodies such as single chain Fv molecules (scFv), minibodies, oligobodies, etc. The term "antibody" does not imply any particular origin, and includes antibodies obtained through non-conventional processes, such as phage display.

The invention provides a process for detecting polypeptides of the invention, comprising the steps of: (a) contacting an antibody of the invention with a biological sample under conditions suitable for the formation of an antibody-antigen complexes; and (b) detecting said complexes.

The invention provides a process for detecting antibodies of the invention, comprising the steps of: (a) contacting a polypeptide of the invention with a biological sample (e.g. a blood or serum sample) under conditions suitable for the formation of an antibody-antigen complexes; and (b) detecting said complexes.

Preferred antibodies bind to a polypeptide of the invention with substantially greater affinity than antibodies known in the art. Preferably, the affinity is at least 1.5-fold, 2-fold, 5-fold 10-fold, 100-fold, 10$^3$-fold, 10$^4$-fold, 10$^5$-fold, 10$^6$-fold etc. stronger than antibodies known in the art.

Nucleic Acids

The invention also provides nucleic acid comprising a nucleotide sequence encoding the polypeptides of the invention. The invention also provides nucleic acid comprising nucleotide sequences having sequence identity to such nucleotide sequences. Identity between sequences is preferably determined by the Smith-Waterman homology search algorithm as described above.

The invention also provides nucleic acid which can hybridize to these nucleic acids. Hybridization reactions can be performed under conditions of different "stringency". Conditions that increase stringency of a hybridization reaction of widely known and published in the art [e.g. page 7.52 of reference 34]. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art [e.g. see refs 34-37, etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

Nucleic acid comprising fragments of these sequences are also provided. These should comprise at least n consecutive nucleotides from the sequences and, depending on the particular sequence, n is 10 or more (e.g. 12, 14, 15, 18, 20, 25, 30, 35, 40, 50, 60, 70, 80, 90, 100, 150, 200 or more). Preferred fragments are those that are common to a nucleic acid sequence of the invention and to a nucleic acid sequence identified in any of references 5, 6, 8, 10 and 11.

The invention provides nucleic acid of formula 5'-X-Y-Z-3', wherein: -X- is a nucleotide sequence consisting of x nucleotides; -Z- is a nucleotide sequence consisting of z nucleotides; -Y- is a nucleotide sequence consisting of either (a) a fragment of a nucleic acid sequence encoding one of SEQ ID NOS: 1 to 596, (b) a fragment of a nucleic acid sequence encoding one of SEQ ID NOS: 597 to 599, or (c) the complement of (a) or (b); and said nucleic acid 5'-X-Y-Z-3' is neither (i) a fragment of either a nucleic acid sequence encoding one of SEQ ID NOS: 1 to 596 or encoding one of SEQ ID NOS: 597 to 599 nor (ii) the complement of (i). The -X- and/or -Z- moieties may comprise a promoter sequence (or its complement).

The invention includes nucleic acid comprising sequences complementary to these sequences (e.g. for antisense or probing, or for use as primers).

Nucleic acids of the invention can be used in hybridization reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labeled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other ExPEC or host cell nucleic acids, generally being at least about 50% pure (by weight), and usually at least about 90% pure. Nucleic acids of the invention are preferably ExPEC nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labeled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes miRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention comprise sequences, but they may also comprise non-ExPEC sequences (e.g. in nucleic acids of formula 5'-X-Y-Z-3', as defined above). This is particularly useful for primers, which may thus comprise a first sequence complementary to a nucleic acid target and a second sequence which is not complementary to the nucleic acid target. Any such non-complementary sequences in the primer are preferably 5' to the complementary sequences. Typical non-complementary sequences comprise restriction sites or promoter sequences.

Nucleic acids of the invention can be prepared in many ways e.g. by chemical synthesis (at least in part), by digesting longer nucleic acids using nucleases (e.g. restriction enzymes), by joining shorter nucleic acids (e.g. using ligases or polymerases), from genomic or cDNA libraries, etc.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T). The terms also imply a direction—the complement of 5'-ACAGT-3' is 5'-ACTGT-3' rather than 5'-TGTCA-3'.

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesized in part or in whole using chemical means.

The invention provides vectors comprising nucleotide sequences of the invention (e.g. cloning or expression vectors) and host cells transformed with such vectors.

The invention also provides a kit comprising primers (e.g. PCR primers) for amplifying a template sequence contained within an ExPEC nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a ExPEC template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site [e.g. ref. 38] or a promoter sequence [e.g. 39]. The first oligonucleotide and/or the second oligonucleotide may include a detectable label (e.g. a fluorescent label).

The invention provides a process for detecting nucleic acid of the invention, comprising the steps of: (a) contacting a nucleic probe according to the invention with a biological sample under hybridizing conditions to form duplexes; and (b) detecting said duplexes.

The invention provides a process for detecting in a biological sample (e.g. blood), comprising the step of contacting nucleic acid according to the invention with the biological sample under hybridizing conditions. The process may involve nucleic acid amplification (e.g. PCR, SDA, SSSR, LCR, TMA, NASBA, etc.) or hybridization (e.g. microarrays, blots, hybridization with a probe in solution etc.). PCR detection of ExPEC in clinical samples has been reported [e.g. see ref. 40]. Clinical assays based on nucleic acid are described in general in ref. 41.

The invention provides a process for preparing a fragment of a target sequence, wherein the fragment is prepared by extension of a nucleic acid primer. The target sequence and/or the primer are nucleic acids of the invention. The primer extension reaction may involve nucleic acid amplification (e.g. PCR, SDA, SSSR, LCR, TMA, NASBA, etc.).

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Vesicles

Reference 42 describes the preparation of vesicles from a uropathogenic (UPEC) strain by the knockout of mltA (a murein lytic transglycosylase) or one or more of the components of the *E. coli* Tol-Pal complex [43], such as tolA, tolQ, tolB, pal and/or tolR. These vesicles can be improved by making one or more further genetic changes to the chromosome of the bacterium or through insertion of episomal elements (e.g. expression vectors) in order to increase the amount of and/or immunoaccessibility of protective antigens on the surface the vesicles.

One way of obtaining such improvements is to up-regulate the expression of the polypeptides of the invention. Many different genetic strategies for increasing the expression of a target protein are well-known in the art and can be distinguished into two broad categories: one relying on modifications of the chromosome (e.g. replacement of the wild-type promoter with a stronger promoter, inactivation of natural repressor genes, etc.) to increase expression of an endogenous gene, and the other based on recombinant expression by episomal elements (e.g. high-copy number plasmids, vectors harboring an engineered target gene, etc.) or integration of a exogenous gene in the chromosome. Practical examples for each of these approaches can be found in references 44 to 50.

Another way of increasing vesicle immunogenicity and selectivity is to down-regulate the expression of immunodominant non-protective antigens or to down-regulate proteins that are homologous to proteins found in commensal strains. Further improvements can be achieved by detoxification of the Lipid A moiety of LPS. Similar changes have been previously described to produce improved vesicles from other Gram-negative pathogens (see for example references 51 & 52).

All the above strategies can be used either alone or in combination to obtain improved vesicles for use in immunogenic compositions. The invention provides a pathogenic *Escherichia coli* bacterium (particularly a UPEC) having a knockout of mltA and/or of a component of its Tol-Pal complex, and one or more of: (i) a chromosomal gene encoding a polypeptide of the invention under the control of a promoter that provides higher expression levels of the polypeptide than the promoter that is naturally associated with the gene encoding the polypeptide; (ii) an autonomously-replicating extra-chromosomal element encoding a polypeptide of the invention; and/or (iii) a genetic modification to reduce the toxicity of the Lipid A moiety of *E. coli* LPS relative to wild-type LPS.

The invention also provides vesicles obtainable by culturing such a bacterium, such as the vesicles that, during culture of the bacterium, are released into the culture medium.

Pharmaceutical Compositions

The invention provides compositions comprising: (a) polypeptide, antibody, vesicles and/or nucleic acid of the invention; and (b) a pharmaceutically acceptable carrier. These compositions may be suitable as immunogenic compositions, for instance, or as diagnostic reagents, or as vaccines. Vaccines according to the invention may either be prophylactic (i.e. to prevent infection) or therapeutic (i.e. to treat infection), but will typically be prophylactic.

In a particular aspect, the invention provides immunogenic compositions comprising one or more outer membrane vesicles (OMVs) expressing or overexpressing one or more polypeptides of the invention. In a particular embodiment, the invention provides an immunogenic composition comprising one or more OMVs expressing or overexpressing one or more polypeptides comprising: (a) an amino acid sequence selected from the group consisting of SEQ ID NOs 22, 120, 219, 221, 305, 371, 400, 489, 555, 565, 597, 598 and 599; (b)

an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a further embodiment, the immunogenic composition comprises a polypeptide comprising a fragment which comprises at least one B-cell epitope of an amino acid sequence selected from the group consisting of SEQ ID NOs 22, 120, 219, 221, 305, 371, 400, 489, 555, 565, 597, 598 and 599.

A 'pharmaceutically acceptable carrier' includes any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, sucrose, trehalose, lactose, and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. Sterile pyrogen-free, phosphate-buffered physiologic saline is a typical carrier. A thorough discussion of pharmaceutically acceptable excipients is available in ref. 296.

Compositions of the invention may include an antimicrobial, particularly if packaged in a multiple dose format.

Compositions of the invention may comprise detergent e.g. a Tween (polysorbate), such as Tween 80. Detergents are generally present at low levels e.g. <0.01%.

Compositions of the invention may include sodium salts (e.g. sodium chloride) to give tonicity. A concentration of 10±2 mg/ml NaCl is typical.

Compositions of the invention will generally include a buffer. A phosphate buffer is typical.

Compositions of the invention may comprise a sugar alcohol (e.g. mannitol) or a disaccharide (e.g. sucrose or trehalose) e.g. at around 15-30 mg/ml (e.g. 25 mg/ml), particularly if they are to be lyophilized or if they include material which has been reconstituted from lyophilized material. The pH of a composition for lyophilization may be adjusted to around 6.1 prior to lyophilization.

Polypeptides of the invention may be administered in conjunction with other immunoregulatory agents. In particular, compositions will usually include a vaccine adjuvant. The adjuvant may be selected from one or more of the group consisting of a TH1 adjuvant and TH2 adjuvant, further discussed below. Adjuvants which may be used in compositions of the invention include, but are not limited to:

A. Mineral-Containing Compositions

Mineral containing compositions suitable for use as adjuvants in the invention include mineral salts, such as aluminium salts and calcium salts. The invention includes mineral salts such as hydroxides (e.g. oxyhydroxides), phosphates (e.g. hydroxyphosphates, orthophosphates), sulphates, etc. [e.g. see chapters 8 & 9 of ref. 53], or mixtures of different mineral compounds (e.g. a mixture of a phosphate and a hydroxide adjuvant, optionally with an excess of the phosphate), with the compounds taking any suitable form (e.g. gel, crystalline, amorphous, etc.), and with adsorption to the salt(s) being preferred. Mineral containing compositions may also be formulated as a particle of metal salt [54].

A typical aluminium phosphate adjuvant is amorphous aluminium hydroxyphosphate with $PO_4$/Al molar ratio between 0.84 and 0.92, included at 0.6 mg $Al^{3+}$/ml. Adsorption with a low dose of aluminium phosphate may be used e.g. between 50 and 100 μg $Al^{3+}$ per conjugate per dose. Where an aluminium phosphate it used and it is desired not to adsorb an antigen to the adjuvant, this is favored by including free phosphate ions in solution (e.g. by the use of a phosphate buffer).

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

The invention can use a mixture of both an aluminium hydroxide and an aluminium phosphate. In this case there may be more aluminium phosphate than hydroxide e.g. a weight ratio of at least 2:1 e.g. $\geq$5:1, $\geq$6:1, $\geq$7:1, $\geq$8:1, $\geq$9:1, etc.

Aluminum salts may be included in vaccines of the invention such that the dose of $Al^{3+}$ is between 0.2 and 1.0 mg per dose.

B. Oil Emulsions

Oil emulsion compositions suitable for use as adjuvants in the invention include squalene-water emulsions, such as MF59 (5% Squalene, 0.5% Tween 80, and 0.5% Span 85, formulated into submicron particles using a microfluidizer) [Chapter 10 of ref. 53; see also refs. 55-57, chapter 12 of ref. 58]. MF59 is used as the adjuvant in the FLUAD™ influenza virus trivalent subunit vaccine. The emulsion advantageously includes citrate ions e.g. 10 mM sodium citrate buffer.

Particularly preferred adjuvants for use in the compositions are submicron oil-in-water emulsions. Preferred submicron oil-in-water emulsions for use herein are squalene/water emulsions optionally containing varying amounts of MTP-PE, such as a submicron oil-in-water emulsion containing 4-5% w/v squalene, 0.25-1.0% w/v Tween 80 (polyoxyelthylenesorbitan monooleate), and/or 0.25-1.0% Span 85 (sorbitan trioleate), and, optionally, N-acetylmuramyl-L-alanyl-D-isogluatminyl-L-alanine-2-(1'-2'-dipalmitoyl-sn-glycero-3-hydroxyphosphosphoryloxy)-ethylamine (MTP-PE). Submicron oil-in-water emulsions, methods of making the same and immunostimulating agents, such as muramyl peptides, for use in the compositions, are described in detail in references 55 & 59-60.

An emulsion of squalene, a tocopherol, and Tween 80 can be used. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably $\leq$1 as this provides a more stable emulsion. One such emulsion can be made by dissolving Tween 80 in PBS to give a 2% solution, then mixing 90 ml of this solution with a mixture of (5 g of DL-α-tocopherol and 5 ml squalene), then microfluidizing the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100) can be used.

An emulsion of squalane, polysorbate 80 and poloxamer 401 ("Pluronic™ L121") can be used. The emulsion can be formulated in phosphate buffered saline, pH 7.4. This emulsion is a useful delivery vehicle for muramyl dipeptides, and has been used with threonyl-MDP in the "SAF-1" adjuvant [61] (0.05-1% Thr-MDP, 5% squalane, 2.5% Pluronic L121 and 0.2% polysorbate 80). It can also be used without the Thr-MDP, as in the "AF" adjuvant [62] (5% squalane, 1.25% Pluronic L121 and 0.2% polysorbate 80). Microfluidization is preferred.

Complete Freund's adjuvant (CFA) and incomplete Freund's adjuvant (IFA) may also be used as adjuvants in the invention.

C. Saponin Formulations [Chapter 22 of ref. 53]

Saponin formulations may also be used as adjuvants in the invention. Saponins are a heterologous group of sterol glycosides and triterpenoid glycosides that are found in the bark, leaves, stems, roots and even flowers of a wide range of plant species. Saponins isolated from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 63. Saponin formulations may also comprise a sterol, such as cholesterol [64].

Combinations of saponins and cholesterols can be used to form unique particles called immunostimulating complexes (ISCOMs) [chapter 23 of ref. 53]. ISCOMs typically also include a phospholipid such as phosphatidylethanolamine or phosphatidylcholine. Any known saponin can be used in ISCOMs. Preferably, the ISCOM includes one or more of QuilA, QHA and QHC. ISCOMs are further described in refs. 64-66. Optionally, the ISCOMS may be devoid of additional detergent(s) [67].

A review of the development of saponin based adjuvants can be found in refs. 68 & 69.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 70-75. Virosomes are discussed further in, for example, ref. 76

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof. Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 77. Such "small particles" of 3dMPL are small enough to be sterile filtered through a 0.22 μm membrane [77]. Other non-toxic LPS derivatives include monophosphoryl lipid A mimics, such as aminoalkyl glucosaminide phosphate derivatives e.g. RC-529 [78,79].

Lipid A derivatives include derivatives of lipid A from *Escherichia coli* such as OM-174. OM-174 is described for example in refs. 80 & 81.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 82, 83 and 84 disclose possible analog substitutions e.g. replacement of guanosine with 2'-deoxy-7-deazaguanosine. The adjuvant effect of CpG oligonucleotides is further discussed in refs. 85-90.

The CpG sequence may be directed to TLR9, such as the motif GTCGTT or TTCGTT [91]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 92-94. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 91 & 95-97.

Other immunostimulatory oligonucleotides include a double-stranded RNA, or an oligonucleotide containing a palindromic sequence, or an oligonucleotide containing a poly(dG) sequence.

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 98 and as parenteral adjuvants in ref.

99. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 100-107. Numerical reference for amino acid substitutions is preferably based on the alignments of the A and B subunits of ADP-ribosylating toxins set forth in ref. 108.

Compounds of formula I, II or III, or salts thereof, can also be used as adjuvants:

I

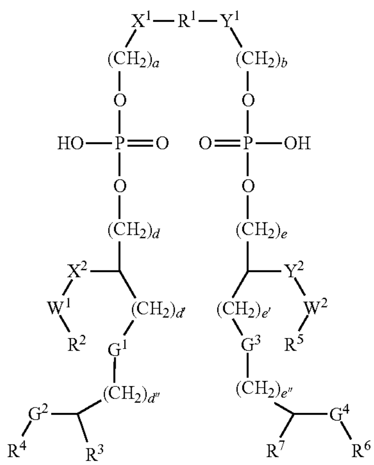

-continued

II

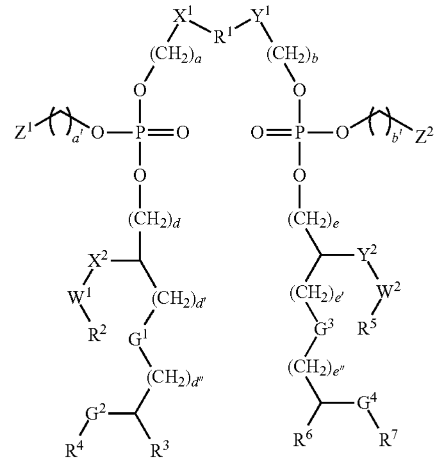

III 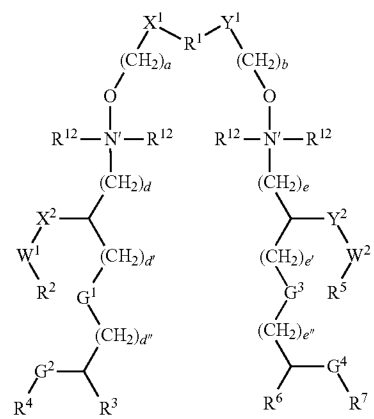 as defined in reference 109, such as 'ER 803058', 'ER 803732', 'ER 804053', ER 804058', 'ER 804059', 'ER 804442', 'ER 804680', 'ER 804764', ER 803022 or 'ER 804057' e.g.:

ER804057

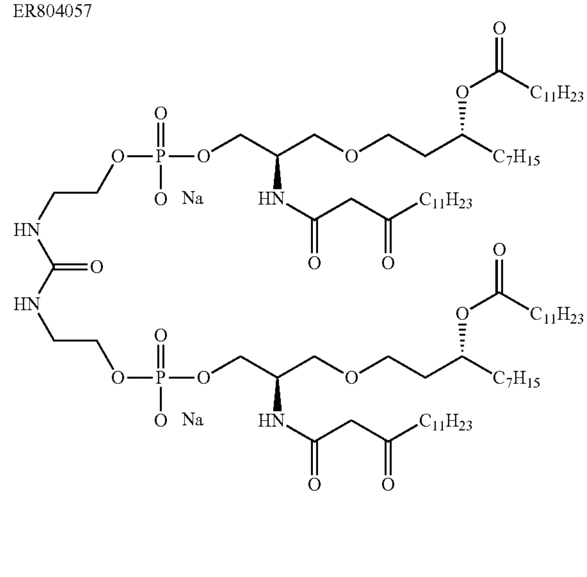

ER-803022:

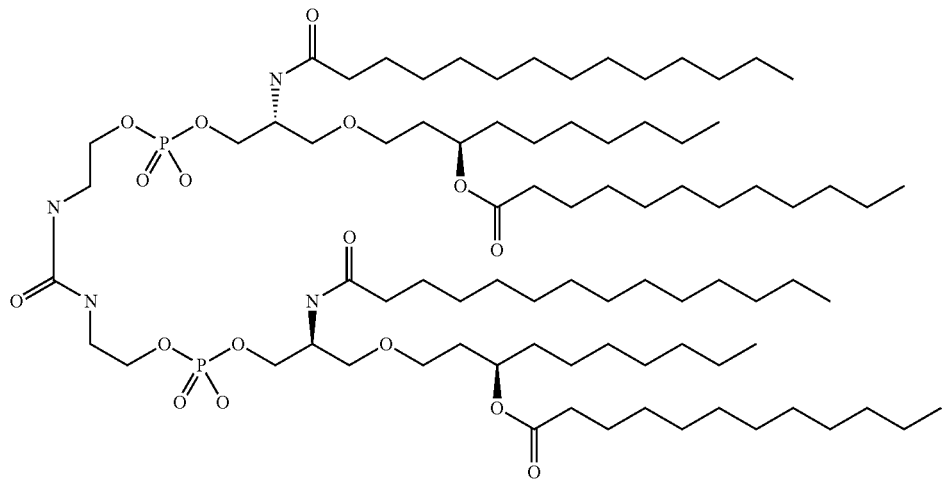

F. Human Immunomodulators

Human immunomodulators suitable for use as adjuvants in the invention include cytokines, such as interleukins (e.g. L-1, IL-2, L-4, IL-5, IL-6, IL-7, IL-12 [110], etc.) [111], interferons (e.g. interferon-γ), macrophage colony stimulating factor, tumor necrosis factor and macrophage inflammatory protein-1alpha (MIP-1alpha) and MP-1beta [112].

G. Bioadhesives and Mucoadhesives

Bioadhesives and mucoadhesives may also be used as adjuvants in the invention. Suitable bioadhesives include esterified hyaluronic acid microspheres [113] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [114].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref 53)

Examples of liposome formulations suitable for use as adjuvants are described in refs. 115-117.

J. Polyoxyethylene Ether and Polyoxyethylene Ester Formulations

Adjuvants suitable for use in the invention include polyoxyethylene ethers and polyoxyethylene esters [118]. Such formulations further include polyoxyethylene sorbitan ester surfactants in combination with an octoxynol [119] as well as polyoxyethylene alkyl ethers or ester surfactants in combination with at least one additional non-ionic surfactant such as an octoxynol [120]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Phosphazenes e.g. PCPP

Phosphazene adjuvants include poly[di(carboxylatophenoxy)phosphazene] ("PCPP") as described, for example, in refs. 121 and 122.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinoline Compounds.

Imidazoquinoline adjuvants include Imiquimod ("R-837") [123,124], Resiquimod ("R-848") [125], and their analogs; and salts thereof (e.g. the hydrochloride salts). Further details about immunostimulatory imidazoquinolines can be found in references 126 to 130.

N. Thiosemicarbazone Compounds.

Examples of thiosemicarbazone compounds, as well as methods of formulating, manufacturing, and screening for compounds all suitable for use as adjuvants in the invention include those described in ref. 131. The thiosemicarbazones are particularly effective in the stimulation of human peripheral blood mononuclear cells for the production of cytokines, such as TNF-α.

O. Tryptanthrin Compounds.

Examples of tryptanthrin compounds, as well as methods of formulating, manufacturing, and screening for compounds all suitable for use as adjuvants in the invention include those described in ref. 132. The tryptanthrin compounds are particularly effective in the stimulation of human peripheral blood mononuclear cells for the production of cytokines, such as TNF-α.

P. Nucleoside Analogs

Various nucleoside analogs can be used as adjuvants, such as (a) Isatorabine (ANA-245; 7-thia-8-oxoguanosine):

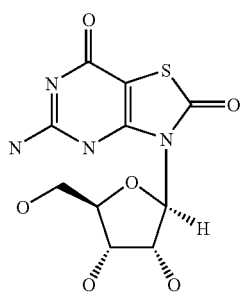

and prodrugs thereof; (b) ANA975; (c) ANA-025-1; (d) ANA380; (e) the compounds disclosed in references 133 to 135; (f) a compound having the formula:

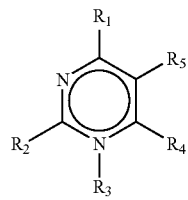

wherein:
- $R_1$ and $R_2$ are each independently H, halo, —$NR_aR_b$, —OH, $C_{1-6}$ alkoxy, substituted $C_{1-6}$ alkoxy, heterocyclyl, substituted heterocyclyl, $C_{6-10}$ aryl, substituted $C_{6-10}$ aryl, $C_{1-6}$ alkyl, or substituted $C_{1-6}$ alkyl;
- $R_3$ is absent, H, $C_{1-6}$ alkyl, substituted $C_{1-6}$ alkyl, $C_{6-10}$ aryl, substituted $C_{6-10}$ aryl, heterocyclyl, or substituted heterocyclyl;
- $R_4$ and $R_5$ are each independently H, halo, heterocyclyl, substituted heterocyclyl, —C(O)—$R_d$, $C_{1-6}$ alkyl; substituted $C_{1-6}$ alkyl, or bound together to form a 5 membered ring as in $R_{4-5}$:

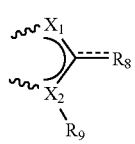

the binding being achieved at the bonds indicated by a ∼∼∼

$X_1$ and $X_2$ are each independently N, C, O, or S;

$R_8$ is H, halo, —OH, $C_{1-6}$ alkyl, $C_{2-6}$ alkenyl, $C_{2-6}$ alkynyl, —OH, —$NR_aR_b$, —$(CH_2)_n$—O—$R_c$, —O—($C_{1-6}$ alkyl), —$S(O)_pR_e$, or —C(O)—$R_d$;

$R_9$ is H, $C_{1-6}$ alkyl, substituted $C_{1-6}$ alkyl, heterocyclyl, substituted heterocyclyl or $R_{9a}$, wherein $R_{9a}$ is:

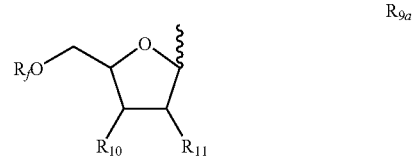

the binding being achieved at the bond indicated by a ∼∼∼

- $R_{10}$ and $R_{11}$ are each independently H, halo, $C_{1-6}$ alkoxy, substituted $C_{1-6}$ alkoxy, —$NR_aR_b$, or —OH;
- each $R_a$ and $R_b$ is independently H, $C_{1-6}$ alkyl, substituted $C_{1-6}$ alkyl, —C(O)$R_d$, $C_{6-10}$ aryl;
- each $R_c$ is independently H, phosphate, diphosphate, triphosphate, $C_{1-6}$ alkoxy, or substituted $C_{1-6}$ alkyl;
- each $R_d$ is independently H, halo, $C_{1-6}$ allyl, substituted $C_{1-6}$ alkyl, $C_{1-6}$ alkoxy, substituted $C_{1-6}$ alkoxy, —$NH_2$, —NH($C_{1-6}$ alkyl), —NH (substituted $C_{1-6}$ alkyl), —N($C_{1-6}$ alkyl)$_2$, —N(substituted $C_{1-6}$ alkyl)$_2$, $C_{6-10}$ aryl, or heterocyclyl;
- each $R_e$ is independently H, $C_{1-6}$ alkyl, substituted $C_{1-6}$ alkyl, $C_{6-10}$ aryl, substituted $C_{6-10}$ aryl, heterocyclyl, or substituted heterocyclyl;
- each $R_f$ is independently H, $C_{1-6}$ alkyl, substituted $C_{1-6}$ alkyl, —C(O)$R_d$, phosphate, diphosphate, or triphosphate;
- each n is independently 0, 1, 2, or 3;
- each p is independently 0, 1, or 2; or or (g) a pharmaceutically acceptable salt of any of (a) to (f), a tautomer of any of (a) to (f), or a pharmaceutically acceptable salt of the tautomer.

Q. Lipids Linked to a Phosphate-Containing Acyclic Backbone

Adjuvants containing lipids linked to a phosphate-containing acyclic backbone include the TLR4 antagonist E5564 [136,137]:

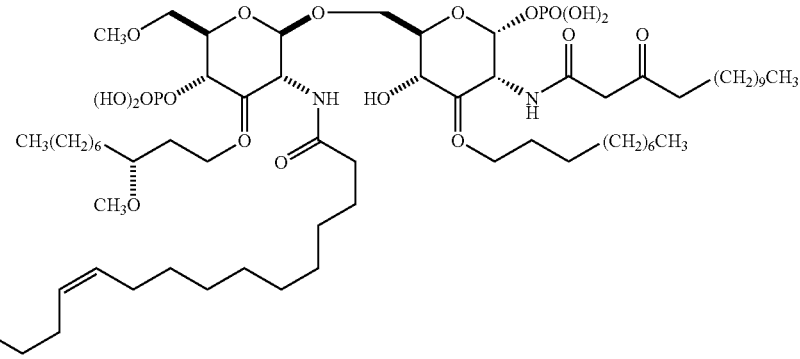

R. Small Molecule Immunopotentiators (SMIPS)
SMIPs include:
N2-methyl-1-(2-methylpropyl)-1H-imidazo[4,5-c]quinoline-2,4-diamine;
N2,N2-dimethyl-1-(2-methylpropyl)-1H-imidazo[4,5-c]quinoline-2,4-diamine;
N2-ethyl-N2-methyl-1-(2-methylpropyl)-1H-imidazo[4,5-c]quinoline-2,4-diamine;
N2-methyl-1-(2-methylpropyl)-N2-propyl-1H-imidazo[4,5-c]quinoline-2,4-diamine;
1-(2-methylpropyl)-N2-propyl-1H-imidazo[4,5-c]quinoline-2,4-diamine;
N2-butyl-1-(2-methylpropyl)-1H-imidazo[4,5-c]quinoline-2,4-diamine;
N2-butyl-N2-methyl-1-(2-methylpropyl)-1H-imidazo[4,5-c]quinoline-2,4-diamine;
N2-methyl-1-(2-methylpropyl)-N2-pentyl-1H-imidazo[4,5-c]quinoline-2,4-diamine;
N2-methyl-1-(2-methylpropyl)-N2-prop-2-enyl-1H-imidazo[4,5-c]quinoline-2,4-diamine;
1-(2-methylpropyl)-2-[(phenylmethyl)thio]-1H-imidazo[4,5-c]quinolin-4-amine;
1-(2-methylpropyl)-2-(propylthio)-1H-imidazo[4,5-c]quinolin-4-amine;
2-[[4-amino-1-(2-methylpropyl)-1H-imidazo[4,5-c]quinolin-2-yl](methyl)amino]ethanol;
2-[[4-amino-1-(2-methylpropyl)-1H-imidazo[4,5-c]quinolin-2-yl](methyl)amino]ethyl acetate;
4-amino-1-(2-methylpropyl)-1,3-dihydro-2H-imidazo[4,5-c]quinolin-2-one;
N2-butyl-1-(2-methylpropyl)-N4,N4-bis(phenylmethyl)-1H-imidazo[4,5-c]quinoline-2,4-diamine;
N2-butyl-N2-methyl-1-(2-methylpropyl)-N4,N4-bis(phenylmethyl)-1H-imidazo[4,5-c]quinoline-2,4-diamine;
N2-methyl-1-(2-methylpropyl)-N4,N4-bis(phenylmethyl)-1H-imidazo[4,5-c]quinoline-2,4-diamine;
N2,N2-dimethyl-1-(2-methylpropyl)-N4,N4-bis(phenylmethyl)-1H-imidazo[4,5-c]quinoline-2,4-diamine;
1-{4-amino-2-[methyl(propyl)amino]-1H-imidazo[4,5-c]quinolin-1-yl}-2-methylpropan-2-ol;
1-[4-amino-2-(propylamino)-1H-imidazo[4,5-c]quinolin-1-yl]-2-methylpropan-2-ol;
N4,N4-dibenzyl-1-(2-methoxy-2-methylpropyl)-N2-propyl-1H-imidazo[4,5-c]quinoline-2,4-diamine.

S. Proteosomes

One adjuvant is an outer membrane protein proteosome preparation prepared from a first Gram-negative bacterium in combination with a liposaccharide preparation derived from a second Gram-negative bacterium, wherein the outer membrane protein proteosome and liposaccharide preparations form a stable non-covalent adjuvant complex. Such complexes include "IVX-908", a complex comprised of Neisseria meningitidis outer membrane and lipopolysaccharides. They have been used as adjuvants for influenza vaccines [138].

T. Other Adjuvants

Other substances that act as immunostimulating agents are disclosed in references 53 and 58. Further useful adjuvant substances include:
Methyl inosine 5'-monophosphate ("MIMP") [139].
A polyhydroxlated pyrrolizidine compound [140], such as one having formula:

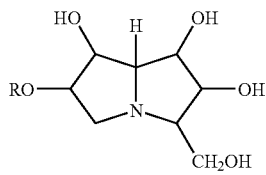

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.

A gamma inulin [141] or derivative thereof, such as algammulin.
Compounds disclosed in reference 142.
Compounds disclosed in reference 143, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [144,145], Hydrapthalamide compounds, Benzophenone compounds, Isoxazole compounds, Sterol compounds, Quinazilinone compounds, Pyrrole compounds [146], Anthraquinone compounds, Quinoxaline compounds, Triazine compounds, Pyrazalopyrimidine compounds, and Benzazole compounds [147].
Loxoribine (7-allyl-8-oxoguanosine) [148].
A formulation of a cationic lipid and a (usually neutral) co-lipid, such as aminopropyl-dimethyl-myristoleyloxy-propanaminium bromide-diphytanoylphosphatidyl-ethanolamine ("Vaxfectin™") or aminopropyl-dimethyl-bis-dodecyloxy-propanaminium bromide-dioleoylphosphatidyl-ethanolamine ("GAP-DLRIE: DOPE"). Formulations containing (±)-N-(3-aminopropyl)-N,N-dimethyl-2,3-bis(syn-9-tetradeceneyloxy)-1-propanaminium salts are preferred [149].

The invention may also comprise combinations of one or more of the adjuvants identified above. For example, the following combinations may be used as adjuvant compositions in the invention: (1) a saponin and an oil-in-water emulsion [150]; (2) a saponin (e.g. QS21)+a non-toxic LPS derivative (e.g. 3dMPL) [151]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [152]; (5) combinations of 3dMPL with, for example, QS21 and/or oil-in-water emulsions [153]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (8) one or more mineral salts (such as an aluminum salt)+a non-toxic derivative of LPS (such as 3dMPL); and (9) one or more mineral salts (such as an aluminum salt)+an immunostimulatory oligonucleotide (such as a nucleotide sequence including a CpG motif).

The compositions of the invention will preferably elicit both a cell mediated immune response as well as a humoral immune response in order to effectively address a uropathogenic infection. This immune response will preferably induce long lasting (e.g. neutralizing) antibodies and a cell mediated immunity that can quickly respond upon exposure to UPEC-associated antigens.

Two types of T cells, CD4 and CD8 cells, are generally thought necessary to initiate and/or enhance cell mediated immunity and humoral immunity. CD8 T cells can express a CD8 co-receptor and are commonly referred to as cytotoxic T lymphocytes (CTLs). CD8 T cells are able to recognized or interact with antigens displayed on MHC Class I molecules. CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4$^+$ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with 1L-12. TH1 stimulated B cells may secrete IgG2a.

Activated TH2 cells enhance antibody production and are therefore of particular value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response. An enhanced TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production. An enhanced TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives hereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response i.e. an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e. relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

The use of an aluminium hydroxide or aluminium phosphate adjuvant is particularly preferred, and antigens are generally adsorbed to these salts. Calcium phosphate is another preferred adjuvant.

The pH of compositions of the invention is preferably between 6 and 8, preferably about 7. Stable pH may be maintained by the use of a buffer. Where a composition comprises an aluminium hydroxide salt, it is preferred to use a histidine buffer [154]. The composition may be sterile and/or pyrogen-free. Compositions of the invention may be isotonic with respect to humans.

Compositions may be presented in vials, or they may be presented in ready-filled syringes. The syringes may be supplied with or without needles. A syringe will include a single dose of the composition, whereas a vial may include a single dose or multiple doses. Injectable compositions will usually be liquid solutions or suspensions. Alternatively, they may be presented in solid form (e.g. freeze-dried) for solution or suspension in liquid vehicles prior to injection.

Compositions of the invention may be packaged in unit dose form or in multiple dose form. For multiple dose forms, vials are preferred to pre-filled syringes. Effective dosage volumes can be routinely established, but a typical human dose of the composition for injection has a volume of 0.5 ml.

Where a composition of the invention is to be prepared extemporaneously prior to use (e.g. where a component is presented in lyophilized form) and is presented as a kit, the kit may comprise two vials, or it may comprise one ready-filled syringe and one vial, with the contents of the syringe being used to reactivate the contents of the vial prior to injection.

Thus the invention provides for a kit comprising a first component and a second component, wherein: the first component comprises one or more polypeptide, antibody, vesicle and/or nucleic acid of the invention; and the second component comprises one or more of the following: instructions for administering a composition to a patient, a syringe or other delivery device, an adjuvant, and/or a pharmaceutically acceptable formulating solution.

The invention also provides a delivery device (e.g. a syringe) pre-filled with the immunogenic compositions of the invention.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials, and a typical quantity of each meningococcal saccharide antigen per dose is between 1 μg and 10 mg per antigen.

Pharmaceutical Uses

The invention also provides a method of treating a patient, comprising administering to the patient a therapeutically effective amount of a composition of the invention. The patient may either be at risk from the disease themselves or may be a pregnant woman ('maternal immunisation' [155]).

The invention provides nucleic acid, polypeptide, vesicle or antibody of the invention for use as medicaments (e.g. as immunogenic compositions or as vaccines) or as diagnostic reagents. It also provides the use of nucleic acid, polypeptide, vesicle or antibody of the invention in the manufacture of: (i) a medicament for treating or preventing disease and/or infection caused by an ExPEC bacterium; (ii) a diagnostic reagent for detecting the presence of or of antibodies raised against an ExPEC bacterium; and/or (iii) a reagent which can raise antibodies against an ExPEC bacterium. Said ExPEC bacterium can be of any serotype or strain. Preferably the ExPEC bacterium is a UPEC strain.

The invention is useful for the prevention and/or treatment of diseases such as bacteremia, meningitis, a urinary tract infection, pyelonephritis and/or cystitis. The invention is particularly useful for the treatment of urinary tract infections.

The patient is preferably a human. The human is preferably an adult (e.g. aged between 20 and 55). A vaccine intended for children or adolescents may also be administered to adults e.g. to assess safety, dosage, immunogenicity, etc. Female patients are a preferred subset, with sexually-active females aged 20-55 being a particularly preferred patient group. Another groups of patients is females aged 12-20, particularly for prophylactic use.

Other possible patient animals include dogs, which may be carriers of ExPEC [156,157].

One way of checking efficacy of therapeutic treatment involves monitoring infection after administration of the composition of the invention. One way of checking efficacy of prophylactic treatment involves monitoring immune responses against an administered polypeptide after administration. Immunogenicity of compositions of the invention can be determined by administering them to test subjects (e.g. children 12-16 months age, or animal models e.g. a mouse model) and then determining standard parameters including ELISA titers (GMT) of IgG. These immune responses will generally be determined around 4 weeks after administration of the composition, and compared to values determined before administration of the composition. Where more than one dose of the composition is administered, more than one post-administration determination may be made. Various mouse models of UTI are available [e.g. refs. 158 & 159-160].

Administration of polypeptide antigens is a preferred method of treatment for inducing immunity. Administration of antibodies of the invention is another preferred method of treatment. This method of passive immunization is particularly useful for newborn children or for pregnant women. This method will typically use monoclonal antibodies, which will be humanized or fully human.

Compositions of the invention will generally be administered directly to a patient. Direct delivery may be accomplished by parenteral injection (e.g. subcutaneously, intraperitoneally, intravenously, intramuscularly, or to the interstitial space of a tissue), or by rectal, oral (e.g. tablet, spray), vaginal, topical, transdermal, transcutaneous, intranasal, sublingual, ocular, aural, pulmonary or other mucosal administration. Intramuscular administration to the thigh or the upper arm is preferred. Injection may be via a needle (e.g. a hypodermic needle), but needle-free injection may alternatively be used. A typical intramuscular dose is 0.5 ml.

The invention may be used to elicit systemic and/or mucosal immunity. Preferably the enhanced systemic and/or mucosal immunity is reflected in an enhanced TH1 and/or TH2 immune response. Preferably, the enhanced immune response includes an increase in the production of IgG1 and/or IgG2a and/or IgA.

Dosage treatment can be a single dose schedule or a multiple dose schedule. Multiple doses may be used in a primary immunization schedule and/or in a booster immunization schedule. A primary dose schedule may be followed by a booster dose schedule. In a multiple dose schedule the various doses may be given by the same or different routes e.g. a parenteral prime and mucosal boost, a mucosal prime and parenteral boost, etc. Suitable timing between priming doses (e.g. between 4-16 weeks), and between priming and boosting, can be routinely determined. For example, a primary course of vaccination may include 1-10 separate doses, followed by other doses given at subsequent time intervals required to maintain and/or reinforce an immune response, for example, at 1-4 months for a second dose, and if needed, a subsequent dose or doses after several months.

Bacterial infections affect various areas of the body and so compositions may be prepared in various forms. For example, the compositions may be prepared as injectables, either as liquid solutions or suspensions. Solid forms suitable for solution in, or suspension in, liquid vehicles prior to injection can also be prepared (e.g. a lyophilized or a spray-freeze dried composition). The composition may be prepared for topical administration e.g. as an ointment, cream or powder. The composition be prepared for oral administration e.g. as a tablet or capsule, as a spray or as a syrup (optionally flavored). The composition may be prepared for pulmonary administration e.g. as an inhaler, using a fine powder or a spray. The composition may be prepared as a suppository or pessary. The composition may be prepared for nasal, aural or ocular administration e.g. as spray, drops, gel or powder [e.g. refs 161 & 162]. The composition may be in kit form, designed such that a combined composition is reconstituted just prior to administration to a patient. Such kits may comprise one or more antigens in liquid form and one or more lyophilized antigens.

Compositions of the invention may be administered to patients at substantially the same time as (e.g. during the same medical consultation or visit to a healthcare professional) other vaccines e.g. at substantially the same time as a measles vaccine, a mumps vaccine, a rubella vaccine, a MMR vaccine, a varicella vaccine, a MMRVi vaccine, a diphtheria vaccine, a tetanus vaccine, a pertussis vaccine, a DTP vaccine, a conjugated H. influenza type b vaccine, a human papillomavirus vaccine, an inactivated poliovirus vaccine, a hepatitis B virus vaccine, a pneumococcal conjugate vaccine, a meningococcal conjugate vaccine, etc. Similarly, they may be administered to patients at substantially the same time as (e.g. during the same medical consultation or visit to a healthcare professional) an antibiotic, and in particular an antibiotic compound active against UPEC.

Further Antigenic Components of Compositions of the Invention

The invention also provides a composition comprising a polypeptide or the invention and one or more of the following further antigens:

- a saccharide antigen from N. meningitidis serogroup A, C, W135 and/or Y (preferably all four), such as the oligosaccharide disclosed in ref. 163 from serogroup C [see also ref. 164] or the oligosaccharides of ref. 165.
- an antigen from N. meningitidis serogroup B such as those disclosed in refs. 166-174, etc.
- a saccharide antigen from Streptococcus pneumonia [e.g. 175, 176, 177].
- an antigen from hepatitis A virus, such as inactivated virus [e.g. 178, 179].
- an antigen from hepatitis B virus, such as the surface and/or core antigens [e.g. 179, 180].
- an antigen from hepatitis C virus [e.g. 181].
- an antigen from HIV [182]
- a diphtheria antigen, such as a diphtheria toxoid [e.g. chapter 3 of ref. 183] e.g. the $CRM_{197}$ mutant [e.g. 184].
- a tetanus antigen, such as a tetanus toxoid [e.g. chapter 4 of ref. 183].
- an antigen from Bordetella pertussis, such as pertussis holotoxin (PT) and filamentous haemagglutinin (FHA) from B. pertussis, optionally also in combination with pertactin and/or agglutinogens 2 and 3 [e.g. refs. 185 & 186].
- a saccharide antigen from Haemophilus influenza B [e.g. 164].
- polio antigen(s) [e.g. 187, 188] such as IPV.
- measles, mumps and/or rubella antigens [e.g. chapters 9, 10 & 11 of ref. 183].
- varicella antigens.
- influenza antigen(s) [e.g. chapter 19 of ref. 183], such as the haemagglutinin and/or neuraminidase surface proteins. Influenza antigens may be derived from interpandemic (annual) flu strains. Influenza antigens may be derived from strains with the potential to cause a pandemic outbreak (i.e., influenza strains with new haemagglutinin compared to the haemagglutinin in currently circulating strains, or influenza strains which are pathogenic in avian subjects and have the potential to be transmitted horizontally in the human population, or influenza strains which are pathogenic to humans). Influenza antigens may be derived from viruses grown in eggs or cell culture.
- an antigen from Moraxella catarrhalis [e.g. 189].
- a saccharide antigen from Streptococcus agalactiae (group B streptococcus).
- an protein antigen from Streptococcus agalactiae (group B streptococcus) [e.g. 190-195]
- an antigen from N. gonorrhea [e.g. 196-199].
- an antigen from Chlamydia pneumonia [e.g. refs. 200 to 206] or a combination of antigens from C. pneumonia [e.g. 207].
- an antigen from Chlamydia trachomatis, or a combination of antigens from C. trachomatis [e.g. 208].
- an antigen from Porphyromonas gingivalis [e.g. 209].
- rabies antigen(s) [e.g. 210] such as lyophilized inactivated virus [e.g. 211, RabAvert™].
- antigen(s) from a paramyxovirus such as respiratory syncytial virus (RSV [212, 213]) and/or parainfluenza virus (PIV3 [214]).
- an antigen from Bacillus anthracis [e.g. 215, 216, 217].
- an antigen from Streptococcus pyogenes (group A streptococcus) [e.g. 191, 218, 219].
- an antigen from Staphylococcus aureus [e.g. 220].
- an antigen from a virus in the flaviviridae family (genus flavivirus), such as from yellow fever virus, Japanese encephalitis virus, four serotypes of Dengue viruses, tick-borne encephalitis virus, West Nile virus.
- a pestivirus antigen, such as from classical porcine fever virus, bovine viral diarrhea virus, and/or border disease virus.
- a parvovirus antigen e.g. from parvovirus B19.
- a human papilloma virus (HPV) antigen [221]

The composition may comprise one or more of these further antigens.

In another embodiment, antigens of the invention are combined with one or more additional, non-E. coli antigens suitable for use in a vaccine designed to protect females against genitourinary and/or sexually transmitted diseases. For example, the antigens may be combined with an antigen derived from the group consisting of Streptococcus agalactiae, Chlamydia trachomatis, Neisseria gonorrhea, papillomavirus and herpes simplex virus. Where human papillomavirus antigens are used, they may be from one or more of HPV 16, HPV 18, HPV 6 and/or HPV 11.

Preferred Gonococcal antigens include one or more of ngs13 (OmpA), OmpH, ngs576 (peptidyl-prolyl cis/trans isomerase (PPIase) protein), ngs41 and ngs117.

Preferred HPV antigens include one or more of HPV 16, HPV 18, HPV 6 and HPV 11.

Preferred Chlamydia trachomatis antigens include one or more of: CT045, CT089, CT242, CT316, CT381. CT396, CT398, CT444, CT467, CT547, CT587, CT823, CT761 and specific combinations of these antigens as disclosed in WO 05/002619.

Preferred Chlamydia pneumonia antigens include one or more of: CPn0324, Cpn0301, Cpn0482, Cpn0503, Cpn0525, Cpn0558, Cpn0584, Cpn0800, Cpn0979, Cpn0498, Cpn0300, Cpn0042, Cpn0013, Cpn450, Cpn0661, Cpn0557, Cpn0904, Clpn0795, Cpn0186 and Cpn0604 and specific combinations of these antigens as disclosed in WO 05/084306.

Preferred GBS antigens include one or more of GBS80, GBS104, GBS 59, GBS 67, GBS 322 and GBS 276.

In another embodiment, the antigen combinations of the invention are combined with one or more additional, non-ExPEC antigens suitable for use in a vaccine designed to protect elderly or immunocompromized individuals. For example, the antigen combinations may be combined with an antigen derived from the group consisting of Enterococcus faecalis, Staphylococcus aureus, Staphylococcus epidermis, Pseudomoizas aeruginosa, Legionella pneumophila, Listeria monocytogenes, Neisseria meningtidies, influenza, and Parainfluenza virus ('PIV').

Toxic protein antigens may be detoxified where necessary (e.g. detoxification of pertussis toxin by chemical and/or genetic means [186]).

Where a diphtheria antigen is included in the composition it is preferred also to include tetanus antigen and pertussis antigens. Similarly, where a tetanus antigen is included it is preferred also to include diphtheria and pertussis antigens.

Similarly, where a pertussis antigen is included it is preferred also to include diphtheria and tetanus antigens. DTP combinations are thus preferred.

Saccharide antigens are preferably in the form of conjugates. Carrier proteins for the conjugates include bacterial toxins (such as diphtheria toxoid or tetanus toxoid), the *N. meningitidis* outer membrane protein [222], synthetic peptides [223,224], heat shock proteins [225,226], pertussis proteins [227,228], protein D from *H. influenza* [229,230], cytokines [231], lymphokines [231], *H. influenza* proteins, hormones [231], growth factors [231], toxin A or B from *C. difficile* [232], iron-uptake proteins [233], artificial proteins comprising multiple human CD4+ T cell epitopes from various pathogen-derived antigens [234] such as the N19 protein [235], pneumococcal surface protein PspA [236], pneumolysin [237], etc. A preferred carrier protein is CRM197 protein [238].

Antigens in the composition will typically be present at a concentration of at least 1 μg/ml each. In general, the concentration of any given antigen will be sufficient to elicit an immune response against that antigen.

Antigens are preferably adsorbed to an aluminium salt.

Nucleic Acid Immunization

The immunogenic compositions described above include polypeptide antigens from UPEC. As an alternative to using proteins antigens in the immunogenic compositions of the invention, nucleic acid (preferably DNA e.g. in the form of a plasmid) encoding the antigen may be used, to give compositions, methods and uses based on nucleic acid immunization. Nucleic acid immunization is now a developed field (e.g. see references 239 to 246 etc.), and has been applied to many vaccines.

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site.

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA therapy techniques are described in, for example, references 247 to 252. Therapeutic compositions containing a nucleic acid are administered in a range of about 100 ng to about 200 mg of DNA for local administration in a gene therapy protocol. Concentration ranges of about 500 ng to about 50 mg, about 1 μg to about 2 mg, about 5 μg to about 500 μg, and about 20 μg to about 100 μg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over, a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 253 to 256).

Viral-based vectors for delivery of a desired nucleic acid and expression in a desired cell are well known in the art. Exemplary viral-based vehicles include, but are not limited to, recombinant retroviruses (e.g. references 257 to 267), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 268 to 273). Administration of DNA linked to killed adenovirus [274] can also be employed.

Non-viral delivery vehicles and methods can also be employed, including, but not limited to, polycationic condensed DNA linked or unlinked to killed adenovirus alone [e.g. 274], ligand-linked DNA [275], eukaryotic cell delivery vehicles cells [e.g. refs. 276 to 280] and nucleic charge neutralization or fusion with cell membranes. Naked DNA can also be employed. Exemplary naked DNA introduction methods are described in refs. 281 and 282. Liposomes (e.g. immunoliposomes) that can act as gene delivery vehicles are described in refs. 283 to 287. Additional approaches are described in references 288 & 289.

Further non-viral delivery suitable for use includes mechanical delivery systems such as the approach described in ref 289. Moreover, the coding sequence and the product of expression of such can be delivered through deposition of photopolymerized hydrogel materials or use of ionizing radiation [e.g. refs. 290 & 291]. Other conventional methods for gene delivery that can be used for delivery of the coding sequence include, for example, use of hand-held gene transfer particle gun [292] or use of ionizing radiation for activating transferred genes [290 & 293].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

General

The term "comprising" encompasses "including" as well as "consisting" e.g. a composition "comprising" X may consist exclusively of X or may include something additional e.g. X+Y.

The term "about" in relation to a numerical value x means, for example, x±10%.

The word "substantially" does not exclude "completely" e.g. a composition which is "substantially free" from Y may be completely free from Y. Where necessary, the word "substantially" may be omitted from the definition of the invention.

The N-terminus residues in the amino acid sequences in the sequence listing are given as the amino acid encoded by the first codon in the corresponding nucleotide sequence. Where the first codon is not ATG, it will be understood that it will be translated as methionine when the codon is a start codon, but will be translated as the indicated non-Met amino acid when the sequence is at the C-terminus of a fusion partner. The invention specifically discloses and encompasses each of the amino acid sequences of the sequence listing having a N-terminus methionine residue (e.g. a formyl-methionine residue) in place of any indicated non-Met residue. It also specifically discloses and encompasses each of the amino acid sequences of the sequence listing starting at any internal methionine residues in the sequences.

As indicated in the above text, nucleic acids and polypeptides of the invention may include sequences that:

(a) are identical (i.e. 100% identical) to the sequences disclosed in the sequence listing;

(b) share sequence identity with the sequences disclosed in the sequence listing;

(c) have 1, 2, 3, 4, 5, 6, 7, 8, 9 or 10 single nucleotide or amino acid alterations (deletions, insertions, substitutions), which may be at separate locations or may be contiguous, as compared to the sequences of (a) or (b); and (d) when aligned with a particular sequence from the sequence listing using a pairwise alignment algorithm, a moving window of x monomers (amino acids or nucleotides) moving from start (N-terminus or 5') to end (C-terminus of 3'), such that for an alignment that extends to p monomers (where p>x) there are p−x+1 such windows, each window has at least x·y identical aligned monomers, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [294], using default parameters (e.g. with Gap opening penalty=10.0, and with Gap extension penalty=0.5, using the EBLOSUM62 scoring matrix). This algorithm is conveniently implemented in the needle tool in the EMBOSS package [295].

The nucleic acids and polypeptides of the invention may additionally have further sequences to the N-terminus/5' and/or C-terminus/3' of these sequences (a) to (d).

The practice of the present invention will employ, unless otherwise indicated, conventional methods of chemistry, biochemistry, molecular biology, immunology and pharmacology, within the skill of the art. Such techniques are explained fully in the literature. See, e.g., references 296-303, etc.

EXPERIMENTAL

Below are examples of specific embodiments or modes for carrying out the present invention. The examples are offered for illustrative purposes only, and are not intended to limit the scope of the present invention in any way.

Efforts have been made to ensure accuracy with respect to numbers used (e.g., amounts, temperatures, etc.), but some experimental error and deviation should, of course, be allowed for.

MODES FOR CARRYING OUT THE INVENTION

Computer-based comparative and predictive tools were used to identify 596 polypeptides that are (a) common to at least two UPEC strains but are not found in non-pathogenic strains, and (b) surface- or membrane-associated. These 596 polypeptides are listed in Table 1, and their amino acid sequences are in the sequence listing as SEQ ID NOS: 1 to 596. Table 1 gives the 'gi' (GenInfo Identifier) accession numbers for these 596 sequences [11], and this information can be used to retrieve information including (a) the full sequence database record for the polypeptide and (b) the corresponding coding sequence from within the E. coli genome. For example, the NCBI Entrez system [304] can be queried with '26111674' to give a single record [305], and the 'CDS' link within that record can be clicked to reveal the corresponding coding sequence [306].

As the polypeptide sequences of the invention are already available in public databases, their annotated functions are also available. Some of the 596 polypeptides have no recognized function in the current annotation (e.g. they are annotated in the databases as 'hypothetical protein'). Although the inventors have not elucidated the basic underlying biological function of these polypeptides, the invention does now provide a credible utility for these polypeptides, namely in the provision of immunogenic compositions as described herein.

Table 4 reports the closest matches to SEQ ID NOS: 1-596 in the non-pathogenic K12 sequences for strains MG1655 [307], W3110 and DH10B.

Table 5 shows the 414/596 polypeptides with the strongest matches between two different UPEC genomes, with the underlined SEQ ID numbers being those with 100% conservation. The remaining 182 polypeptides are more-weakly conserved between UPEC strains, and so the Table 5 polypeptides are preferred particularly underlined ones).

Of the 596 sequences, 156 were selected in preference (Table 2). Table 6 shows various pieces of information for these 156 sequences.

66 further preferred antigens were selected (Table 3) as being absent from non-pathogenic strains, surface-associated, present in at least two UPEC strains, and not previously identified as antigens. 19 of these were selected for initial work (marked with '+' in Table 3).

These polypeptides are cloned, expressed and purified. The purified antigens are used to immunize mice, whose sera are analyzed by Western blot, ELISA and FACS, and are further tested in both in vitro and in vivo experiments. Suitable in vitro experiments include testing the ability of antibodies to induce complement-mediated bacterial killing and/or opsonophagocytosis activity, to block binding of ExPEC strains (or the purified antigen) to human epithelial cells (e.g. in bladder cells) or other cell lines, and/or to inhibit adhesion/invasion of *E. coli* bacteria (e.g. K1 strain) to brain microvascular endothelial cells (BMEC). Suitable in vivo experiments include active and/or passive systemic immunizations and challenge in mouse models of UTI (adult mice), protection by active or passive immunizations against bacteremia and meningitis in 5-day-old rats challenged with *E. coli* K1 strain, and immunization and intraperitoneal infection of adult mice with an ExPEC strain.

The importance of the proteins to the bacterial life-cycle is tested by creating isogenic knockout mutants. The mutants can also be used to ensure that sera raised by an antigen are specific for that antigen. Microarrays are used to study expression patterns. Conservation and/or variability is assessed by sequencing the genes from multiple different ExPEC strains.

Assays were carried out in order to select predicted surface-exposed proteins, which are specific for UPEC strains and absent in non-pathogenic strains (commensal and laboratory strains). Once selected these proteins are expressed and purified and used to immunize mice.

It is known from reference 43 that a mutation in any of the tol-pal genes of *E. coli* results in the formation of vesicles containing native outer membrane proteins. By comparing the proteins present in vesicles of UPEC strains and non-pathogenic strains it is possible to select a small group of proteins that could be used as potential antigens.

Lambda Red-Mediated Gene Manipulation in Commensal and Pathogenic *E. coli*

This method is a rapid PCR-based method used to inactivate the tolR gene from the wild-type *E. coli* strains [308]. Briefly, the first step consists in amplifying independently the upstream and downstream regions of the target gene (tolR) and the resistance marker cassette. The two PCR products obtained in step 1 are mixed with the amplification producer of the AB cassette at equimolar concentrations and submitted to a second round of PCR (a three way PCR) to generate a resistance marker cassette flanked by upstream and downstream 500 bp (or more) regions homologous to the target gene. In the third step, large amounts (1 μg) of the desired linear DNA are electroporated into lamda-red competent cells.

Vesicle Preparation

1. Vesicle Preparation by Precipitation with TCA

LB media was inoculated with bacteria grown on plates and incubated overnight at 37° C. under gentle shaking. The culture was used to inoculate 200 ml of LB at OD600 0.1. Bacteria were grown to OD600 0.4 (or as specified). Culture was centrifuged for 10 minutes at 4000×g and the supernatant was filtered through a 0.22 mm filter to remove residual bacteria.

The same experiments were also performed under iron limiting conditions by adding Dipyridyl (0.25 mM) to the LB media.

Precipitation was performed by adding to the culture supernatant 10% final of a solution at 100% (w/v) TCA, 0.4% (w/v) deoxycholate. The precipitation was allowed to proceed for 30 minutes at 4° C. Precipitate was recovered by 10 minutes centrifugation at 20000×g at 4° C. The pellet was washed once with 10% TCA (w/v) and twice with absolute ethanol. The pellet was dried with speed vac, and stored at −20° C.

The wild type and mutated strains were subjected to SDS polyacrylamide gel electrophoresis from which it could be observed that there were many more bands in the supernatant of the mutated strains than the wildtype strains. Randomly picked bands demonstrated that all the proteins in the supernatant were membrane proteins.

2. Vesicle Preparation by Ultracentrifugation

Culture supernatant was ultracentrifuged at 200000×g for 2 hours at 4° C. The pellet was washed with PBS, resuspended in PBS, and stored at −20° C.

3. Guanidinium Denaturation of the Vesicles

Prior to the guanidinium denaturation, Vesicles were precipitated with ethanol. 10 μg of OMV in PBS were precipitate by adding cold absolute ethanol to 90% final. Precipitation was allowed to proceed for 20 minutes at −20° C. Precipitate was recovered by 10 minutes centrifugation at 13000×g. Pellet was resuspended with 50 ml, 6M guanidinium, 15 mM DTT, 200 mM Tris-HCl, pH 8.0. Denaturation was allowed to proceed for 60 minutes at 60° C. Prior to digestion, solution was diluted ⅛ with a solution of 1.5M Tris pH 8.0 and 5 mg of trypsin were added to the diluted solution. Digestion was allowed to proceed overnight at 37° C. Reaction was stopped by adding 0.1% final of formic acid. Peptides were extracted using Oasis extraction cartridges. Peptides were analyzed by LC coupled MS-MS.

4. Surface Digestion 5 mg of trypsin were added to 10 mg of vesicles in PBS and incubated at 37° C. for 3 hours. Reaction was stopped by adding 0.1% final of formic acid. Peptides were recovered by filtration through a 30 Kda cut-off filter and extracted with Oasis extraction cartridge. Peptides were analyzed with LC coupled MSMS.

Vesicle Analysis

Protein Quantification

Proteins were quantified with the Bradford method, using the BSA as standard.

SDS-PAGE

Samples were analyzed with a sodium dodecyl sulfate (SDS) 4-12% polyacrylamide gel, using a Mini-Protean II electrophoresis apparatus. Samples were suspended in SDS sample buffer (0.06 M Tris-HCl pH 6.8, 10% (v/v) glycerol, 2% (w/v) SDS, 5% (v/v) 2-mercaptoethanol, 10 mg/ml bromophenol blue) and heated to 100° C. for 5 min before SDS-polyacrylamide gel electrophoreis. After the run, gels were stained with Coomassie Blue MALDI-TOF Mass Spectrometry.

Protein bands or spots were excised from gels, washed with 50 mM ammonium bicarbonate/acetonitrile (50/50, v/v), and dried with a Speed-Vac centrifuge (Savant). The dried spots were digested at 37° C. for 2 h by adding 7 to 10 ml of a solution containing 5 mM ammonium bicarbonate, 0.012 mg of sequencing-grade trypsin. After digestion 0.6 ml were loaded on a matrix pre-spotted target and air-dried. Spots were washed with 0.6 ml of a solution of 70% ethanol, 0.1% trifluoracetic acid. Mass spectra were acquired on an ultraflex MALDI TOF mass spectrometer. Spectra were externally calibrated by using a combination of standards pre-spotted on the target. Protein identification was carried out by both automatic and manual comparisons of experimentally generated monoisotopic peaks of peptides in the mass range of 700 to 3,000 Da with computer-generated fingerprints, using the Mascot program.

Bi-Dimensional Electrophoresis 200 mg of vesicles were resuspended in an Immobiline re-swelling solution (7M urea, 2M thiourea, 2% (w/v) CHAPS (2% w/v) ASB14, 2% (v/v) IPG buffer pH 3-10 NL, 2 mM TBP, 65 mM DTT), and adsorbed overnight on 7 cm Immobiline DryStrips (pH 3-10 NL). Proteins were then separated by 2D electrophoresis. The first dimension was run using a IPGphor Isoelectric Focusing Unit, applying sequentially 150 V for 35 minutes, 500 V for 35 minutes, 1,000 V for 30 minutes, 2,600 V for 10 minutes, 3,500 V for 15 minutes, 4,200 V for 15 minutes, and finally 5,000 V to reach 10 kVh. For the second dimension, the strips were equilibrated by two 10 minute-incubations in 4 M urea, 2 M thiourea, 30% glycerol, 2% SDS, 5 mM TBP, 50 Mm Tris HCl pH 8.8, 2.5% acrylamide, Bromo phenol Blue 0.2%: Proteins were then separated on linear 4-12% precasted polyacrylamide gels.

Gels were stained with colloidal Coomassie Blue and scanned with a Personal Densitometer SI. Images were analyzed with Image Master 2D Elite software.

Nano-LC/MS/MS

Peptides were separated by nano-LC on a CapLC HPLC system connected to a Q-ToF Micro ESI mass spectrometer equipped with a nanospray source. Samples were loaded onto an Atlantis C18 NanoEase column (100 µm i.d.×100 mm), through a C18 trap column (300 µm i.d.×5 mm). Peptides were eluted with a 50-min gradient from 2% to 60% of 95% ACN, in a solution of 0.1% formic acid at a flow rate of 400 nl/minute. The eluted peptides were subjected to an automated data-dependent acquisition program, using the MassLynx software, version 4.0, where a MS survey scan was used to automatically select multi-charged peptides over the m/z range of 400-2,000 for further MS/MS fragmentation. Up to three different components where subjected to MS/MS fragmentation at the same time. After data acquisition, the individual MS/MS spectra were combined, smoothed and centroided by MassLynx. Search and identification of peptides were performed in batch mode with a licensed version of MASCOT. The MASCOT search parameters were: (1) species: ExPEC (2) allowed number of missed cleavages (only for trypsin digestion): 6; (3) variable post-translational modifications: methionine oxidation; (4) peptide tolerance: ±500 ppm; (5) MS/MS tolerance: ±0.3 Da and (6): peptide charge: from +1 to +4. As for the previous platform, only significant hits as defined by MASCOT probability analysis were considered. The score thresholds for acceptance of protein identifications from at least one peptide were set by MASCOT as 18 for trypsin digestion and 36 for proteinase K digestion.

Results

As a result of the above analyses, 13 preferred antigens were identified from the CFT073 strain. Namely: gi-26110866 (SEQ ID No 489), gi-26109898 (SEQ ID No 597), gi-26107513 (SEQ ID No 120), gi-26108604 (SEQ ID No 598), gi-26109137 (SEQ ID No 305), gi-26106493 (SEQ ID No 22), gi-26108194 (SEQ ID No 221), gi-26108192 (SEQ ID No 219), gi-26109931 (SEQ ID No 400), gi-26111428 (SEQ ID No 565), gi-26109835 (SEQ ID No 371), gi-26109866 (SEQ ID No 599) and gi-26111414 (SEQ ID No 555). These are listed in Table 7.

Antigen Analysis

Mouse Model of Systemic Infection

To screen a large number of antigens selected by comparative genome analysis between pathogenic and non pathogenic E. coli strains, a protection model based on a classical virulence assay has been established. Alternative experimental models that may also be used include those outlined in references 158, 159 and 160.

The experimental model (immunization and infection) uses 5 week old—CD1 outbreed mice which are challenged with intraperitoneal inoculation of virulent CFT073 E. coli strain. The challenge dose has been experimentally determined as the amount of bacteria able to kill 80% of adult mice within 72 hours and corresponds to $7 \times 10^7$ cfu/mouse for the CFT073 strain.

Immunization Protocol

Mice are immunized three times by subcutaneous injection of 150 µl of protein solution using freund's adjuvants as shown in the table below:

|  | Control mice: | Immunized mice: |
| --- | --- | --- |
| Day 0 | 75 µl of saline solution<br>75 µl of complete freund's adjuvant | 75 µl of protein solution (20 µg)<br>75 µl of complete freund's adjuvant |
| Day 21 | 75 µl of saline solution<br>75 µl of incomplete freund's adjuvant | 75 µl of protein solution (20 µg)<br>75 µl of incomplete freund's adjuvant |
| Day 35 | 75 µl of saline solution<br>75 µl of incomplete freund's adjuvant | 75 µl of protein solution (20 µg)<br>75 µl of incomplete freund's adjuvant |

Blood samples are collected the day before the first immunization (preimmune serum), at day 34 and 48 (day before challenge). Sera from immunized animals are tested by western blot and ELISA to determine the antibodies titer.

Challenge

At day 48 E. coli CFT073 strain is streaked on LB agar plate from frozen stock and incubated overnight (ON) at 37° C. in incubator. At Day 49 the ON plate-culture is used to inoculate 50 ml of LB medium to have an $O.D._{600}=0.1$, and grown for 1.5 hours at 37° C. under agitation until the bacterial culture reaches an $O.D._{600}=0.6$ which corresponds to $7 \times 10^8$ cfu/ml for the CFT073 strain. The culture is centrifuged and the pellet resuspended in the same volume with physiological solution and used for challenge undiluted. The culture is plated using a standard plate count method to verify the inoculum. 100 µl of the cell suspension containing $7 \times 10^7$ CFT073 bacteria is injected intraperitoneally, using a 1 ml syringe, to control and immunized mice The number of deaths in each animal group at 24, 48 and 72 hours after infection are recorded.

The protection due to vaccination is evaluated by comparison of the survival in the vaccinated group and the survival in control group of mice at 72 hours from the challenge. Percentage of survival relative to controls is calculated using the formula:

$$\frac{\text{rate of survival in vaccine group} - \text{rate of survival in control group}}{\text{rate of survival in control group}}$$

Results

Immunization was carried out with heat-inactivated CFT073. As can be seen in FIG. 1, the % survival of the mice after challenge with CFT073 is increased following immunization with heat-inactivated CFT073.

Immunization Studies

Antigens are selected for combining to give a composition of the invention. BALB/c mice are divided into nine groups and immunized as follows:

| Group | Immunizing Composition | Route of Delivery |
|---|---|---|
| 1 | Mixture of antigens (10-20 μg protein/each) + CFA (Complete Freund's Adjuvant) | Intra-peritoneal or intra-nasal or subcutaneous |
| 2 | Mixture of antigens (5 μg/each) + Al-hydroxide (200 μg) | Intra-peritoneal or intra-nasal or subcutaneous |
| 3 | Mixture of antigens (10-20 μg protein/each) + CpG (10 ug) | Intra-peritoneal or intra-nasal or subcutaneous |
| 4 | Mixture of antigens (10-20 μg protein/each) + Al-hydroxide (200 μg) + CpG (10 μg) | Intra-peritoneal or intra-nasal or subcutaneous |
| 5 | CFA | Intra-peritoneal or intra-nasal or subcutaneous |
| 6 | Mixture of antigens (10-20 μg protein/each) + LTK63 (5 μg) | Intra-peritoneal or Intranasal or subcutaneous |
| 7 | Al-hydroxide (200 μg) + CpG (10 μg) | Intra-peritoneal or intra-nasal or subcutaneous |
| 8 | CpG (10 μg) | Intra-peritoneal or intra-nasal or subcutaneous |
| 9 | LTK63 (5 μg) | Intra-peritoneal or intra-nasal or subcutaneous |

Mice are immunized at two-week intervals. Two to three weeks after the last immunization, all mice are challenged with the appropriate UPEC strain. When mucosal immunization (e.g. intranasal) is used, the animal model is also challenged mucosally to test the protective effect of the mucosal immunogen. Immediately prior to challenge, mice are bled to determine antibody titer to the antigens that were administered.

For the mouse challenge, virulent bacteria will be grown in appropriate media. Bacteria are harvested by centrifugation, re-suspended, and serially diluted for the challenge inoculum. BALB/c mice are challenged and observed daily for 30 days post-exposure.

Total IgG and IgG1/IgG2A subtypes can be measured in mouse sera resulting from the different immunization regimens by using an ELISA assay on whole bacteria and on purified recombinant proteins. Furthermore, assessment of antigen-specific CD4+ and CD8+Th-cells in spleen cells and/or PBMC isolated from immunized mice can be carried out by multi-parametric FACS analysis, to evaluate the cytokine expression profiles of antigen-specific T-cells. In particular production of IFN-γ and IL-5 can be measured after in vitro stimulation of T cells with purified antigens. In addition, splenocytes and/or PBMC from mice immunized with each antigen/vaccine formulation may be collected 10-12 days after the last immunization dose and stimulated with UPEC bacteria. After 4 hours of stimulation, Brefeldin A is added to the cells for the following 12 hours, to block cytokine secretion. Afterwards cells are fixed and stained with antibodies to detect UPEC-specific T cells expressing IFN-γ and IL-5.

T cells can be isolated from peripheral blood lymphocytes (PBLs) by a variety of procedures known to those skilled in the art. For example, T cell populations can be "enriched" from a population of PBLs through the removal of accessory and B cells. In particular, T cell enrichment can be accomplished by the elimination of non-T cells using anti-MHC class II monoclonal antibodies. Similarly, other antibodies can be used to deplete specific populations of non-T cells. For example, anti-Ig antibody molecules can be used to deplete B cells and anti-MacI antibody molecules can be used to deplete macrophages.

T cells can be further fractionated into a number of different subpopulations by techniques known to those skilled in the art. Two major subpopulations can be isolated based on their differential expression of the cell surface markers CD4 and CD8. For example, following the enrichment of T cells as described above, CD4+ cells can be enriched using antibodies specific for CD4. The antibodies may be coupled to a solid support such as magnetic beads. Conversely, CD8+ cells can be enriched through the use of antibodies specific for CD4 (to remove CD4+ cells), or can be-isolated by the use of CD8 antibodies coupled to a solid support. CD4 lymphocytes from UPEC-infected patients can be expanded ex vivo, before or after transduction.

Following purification of T cells, the purified T cells are pre-stimulated with various cytokines including but not limited to rIL-2, IL-10, IL-12, and IL-15, which promote growth and activation of lymphocytes.

UPEC-specific T cells, may be activated by the above described immunogenic polypeptides. UPEC-specific T cells can be CD8+ or CD4+. UPEC-specific CD8+ T cells can be cytotoxic T lymphocytes (CTL) which can kill UPEC-infected cells that display any of the above described polypeptides or fragments thereof complexed with an MHC class I molecule. *Chlamydia*-specific CD8+ T cells can be detected by, for example, $^{51}$Cr release assays. $^{51}$Cr release assays measure the ability of UPEC-specific CD8+ T cells to lyse target cells displaying one or more of these epitopes. UPEC-specific CD8+ T cells which express antiviral agents, such as IFN γ, are also contemplated herein and can also be detected by immunological methods, preferably by intracellular staining for IFN-γ or alike cytokines after in vitro stimulation with one or more of the above described UPEC polypeptides. UPEC-specific CD4+ T cells can be detected by a lymphoproliferation assay. Lymphoproliferation assays measure the ability of UPEC-specific CD4+ T cells to proliferate in response to one or more of the above described polypeptides.

It will be understood that the invention has been described by way of example only and modifications may be made whilst remaining within the scope and spirit of the invention.

TABLE 1

599 pathogenic *E.coli* sequences

| | | |
|---|---|---|
| gi-26106321 (SEQ ID NO: 1) | gi-26106323 (SEQ ID NO: 2) | gi-26106335 (SEQ ID NO: 3) |
| gi-26106336 (SEQ ID NO: 4) | gi-26106340 (SEQ ID NO: 5) | gi-26106348 (SEQ ID NO: 6) |
| gi-26106390 (SEQ ID NO: 7) | gi-26106403 (SEQ ID NO: 8) | gi-26106445 (SEQ ID NO: 9) |
| gi-26106446 (SEQ ID NO: 10) | gi-26106449 (SEQ ID NO: 11) | gi-26106454 (SEQ ID NO: 12) |
| gi-26106474 (SEQ ID NO: 13) | gi-26106475 (SEQ ID NO: 14) | gi-26106476 (SEQ ID NO: 15) |
| gi-26106477 (SEQ ID NO: 16) | gi-26106478 (SEQ ID NO: 17) | gi-26106479 (SEQ ID NO: 18) |
| gi-26106480 (SEQ ID NO: 19) | gi-26106483 (SEQ ID NO: 20) | gi-26106492 (SEQ ID NO: 21) |

TABLE 1-continued

| 599 pathogenic E.coli sequences | | |
|---|---|---|
| gi-26106493 (SEQ ID NO: 22) | gi-26106557 (SEQ ID NO: 23) | gi-26106569 (SEQ ID NO: 24) |
| gi-26106579 (SEQ ID NO: 25) | gi-26106582 (SEQ ID NO: 26) | gi-26106583 (SEQ ID NO: 27) |
| gi-26106584 (SEQ ID NO: 28) | gi-26106585 (SEQ ID NO: 29) | gi-26106592 (SEQ ID NO: 30) |
| gi-26106594 (SEQ ID NO: 31) | gi-26106595 (SEQ ID NO: 32) | gi-26106596 (SEQ ID NO: 33) |
| gi-26106597 (SEQ ID NO: 34) | gi-26106598 (SEQ ID NO: 35) | gi-26106601 (SEQ ID NO: 36) |
| gi-26106624 (SEQ ID NO: 37) | gi-26106625 (SEQ ID NO: 38) | gi-26106626 (SEQ ID NO: 39) |
| gi-26106627 (SEQ ID NO: 40) | gi-26106628 (SEQ ID NO: 41) | gi-26106629 (SEQ ID NO: 42) |
| gi-26106630 (SEQ ID NO: 43) | gi-26106633 (SEQ ID NO: 44) | gi-26106635 (SEQ ID NO: 45) |
| gi-26106637 (SEQ ID NO: 46) | gi-26106645 (SEQ ID NO: 47) | gi-26106648 (SEQ ID NO: 48) |
| gi-26106649 (SEQ ID NO: 49) | gi-26106652 (SEQ ID NO: 50) | gi-26106656 (SEQ ID NO: 51) |
| gi-26106657 (SEQ ID NO: 52) | gi-26106658 (SEQ ID NO: 53) | gi-26106659 (SEQ ID NO: 54) |
| gi-26106662 (SEQ ID NO: 55) | gi-26106663 (SEQ ID NO: 56) | gi-26106664 (SEQ ID NO: 57) |
| gi-26106689 (SEQ ID NO: 58) | gi-26106690 (SEQ ID NO: 59) | gi-26106694 (SEQ ID NO: 60) |
| gi-26106705 (SEQ ID NO: 61) | gi-26106706 (SEQ ID NO: 62) | gi-26106710 (SEQ ID NO: 63) |
| gi-26106722 (SEQ ID NO: 64) | gi-26106723 (SEQ ID NO: 65) | gi-26106740 (SEQ ID NO: 66) |
| gi-26106931 (SEQ ID NO: 67) | gi-26107030 (SEQ ID NO: 68) | gi-26107046 (SEQ ID NO: 69) |
| gi-26107049 (SEQ ID NO: 70) | gi-26107050 (SEQ ID NO: 71) | gi-26107051 (SEQ ID NO: 72) |
| gi-26107053 (SEQ ID NO: 73) | gi-26107067 (SEQ ID NO: 74) | gi-26107097 (SEQ ID NO: 75) |
| gi-26107223 (SEQ ID NO: 76) | gi-26107228 (SEQ ID NO: 77) | gi-26107235 (SEQ ID NO: 78) |
| gi-26107239 (SEQ ID NO: 79) | gi-26107241 (SEQ ID NO: 80) | gi-26107246 (SEQ ID NO: 81) |
| gi-26107247 (SEQ ID NO: 82) | gi-26107248 (SEQ ID NO: 83) | gi-26107249 (SEQ ID NO: 84) |
| gi-26107251 (SEQ ID NO: 85) | gi-26107258 (SEQ ID NO: 86) | gi-26107260 (SEQ ID NO: 87) |
| gi-26107263 (SEQ ID NO: 88) | gi-26107265 (SEQ ID NO: 89) | gi-26107266 (SEQ ID NO: 90) |
| gi-26107267 (SEQ ID NO: 91) | gi-26107269 (SEQ ID NO: 92) | gi-26107309 (SEQ ID NO: 93) |
| gi-26107393 (SEQ ID NO: 94) | gi-26107451 (SEQ ID NO: 95) | gi-26107452 (SEQ ID NO: 96) |
| gi-26107455 (SEQ ID NO: 97) | gi-26107459 (SEQ ID NO: 98) | gi-26107461 (SEQ ID NO: 99) |
| gi-26107465 (SEQ ID NO: 100) | gi-26107468 (SEQ ID NO: 101) | gi-26107469 (SEQ ID NO: 102) |
| gi-26107470 (SEQ ID NO: 103) | gi-26107471 (SEQ ID NO: 104) | gi-26107473 (SEQ ID NO: 105) |
| gi-26107476 (SEQ ID NO: 106) | gi-26107477 (SEQ ID NO: 107) | gi-26107480 (SEQ ID NO: 108) |
| gi-26107483 (SEQ ID NO: 109) | gi-26107484 (SEQ ID NO: 110) | gi-26107486 (SEQ ID NO: 111) |
| gi-26107498 (SEQ ID NO: 112) | gi-26107499 (SEQ ID NO: 113) | gi-26107502 (SEQ ID NO: 114) |
| gi-26107505 (SEQ ID NO: 115) | gi-26107506 (SEQ ID NO: 116) | gi-26107507 (SEQ ID NO: 117) |
| gi-26107508 (SEQ ID NO: 118) | gi-26107509 (SEQ ID NO: 119) | gi-26107513 (SEQ ID NO: 120) |
| gi-26107514 (SEQ ID NO: 121) | gi-26107515 (SEQ ID NO: 122) | gi-26107516 (SEQ ID NO: 123) |
| gi-26107517 (SEQ ID NO: 124) | gi-26107518 (SEQ ID NO: 125) | gi-26107524 (SEQ ID NO: 126) |
| gi-26107525 (SEQ ID NO: 127) | gi-26107528 (SEQ ID NO: 128) | gi-26107529 (SEQ ID NO: 129) |
| gi-26107530 (SEQ ID NO: 130) | gi-26107534 (SEQ ID NO: 131) | gi-26107537 (SEQ ID NO: 132) |
| gi-26107540 (SEQ ID NO: 133) | gi-26107541 (SEQ ID NO: 134) | gi-26107542 (SEQ ID NO: 135) |
| gi-26107544 (SEQ ID NO: 136) | gi-26107548 (SEQ ID NO: 137) | gi-26107550 (SEQ ID NO: 138) |
| gi-26107554 (SEQ ID NO: 139) | gi-26107578 (SEQ ID NO: 140) | gi-26107639 (SEQ ID NO: 141) |
| gi-26107666 (SEQ ID NO: 142) | gi-26107673 (SEQ ID NO: 143) | gi-26107682 (SEQ ID NO: 144) |
| gi-26107688 (SEQ ID NO: 145) | gi-26107690 (SEQ ID NO: 146) | gi-26107692 (SEQ ID NO: 147) |
| gi-26107693 (SEQ ID NO: 148) | gi-26107698 (SEQ ID NO: 149) | gi-26107699 (SEQ ID NO: 150) |
| gi-26107703 (SEQ ID NO: 151) | gi-26107707 (SEQ ID NO: 152) | gi-26107708 (SEQ ID NO: 153) |
| gi-26107714 (SEQ ID NO: 154) | gi-26107719 (SEQ ID NO: 155) | gi-26107725 (SEQ ID NO: 156) |
| gi-26107730 (SEQ ID NO: 157) | gi-26107735 (SEQ ID NO: 158) | gi-26107739 (SEQ ID NO: 159) |
| gi-26107741 (SEQ ID NO: 160) | gi-26107751 (SEQ ID NO: 161) | gi-26107753 (SEQ ID NO: 162) |
| gi-26107755 (SEQ ID NO: 163) | gi-26107757 (SEQ ID NO: 164) | gi-26107759 (SEQ ID NO: 165) |
| gi-26107765 (SEQ ID NO: 166) | gi-26107774 (SEQ ID NO: 167) | gi-26107788 (SEQ ID NO: 168) |
| gi-26107791 (SEQ ID NO: 169) | gi-26107794 (SEQ ID NO: 170) | gi-26107808 (SEQ ID NO: 171) |
| gi-26107811 (SEQ ID NO: 172) | gi-26107813 (SEQ ID NO: 173) | gi-26107817 (SEQ ID NO: 174) |
| gi-26107823 (SEQ ID NO: 175) | gi-26107835 (SEQ ID NO: 176) | gi-26107839 (SEQ ID NO: 177) |
| gi-26107843 (SEQ ID NO: 178) | gi-26107851 (SEQ ID NO: 179) | gi-26107854 (SEQ ID NO: 180) |
| gi-26107855 (SEQ ID NO: 181) | gi-26107858 (SEQ ID NO: 182) | gi-26107861 (SEQ ID NO: 183) |
| gi-26107864 (SEQ ID NO: 184) | gi-26107866 (SEQ ID NO: 185) | gi-26107867 (SEQ ID NO: 186) |
| gi-26107869 (SEQ ID NO: 187) | gi-26107890 (SEQ ID NO: 188) | gi-26107912 (SEQ ID NO: 189) |
| gi-26107916 (SEQ ID NO: 190) | gi-26107917 (SEQ ID NO: 191) | gi-26107918 (SEQ ID NO: 192) |
| gi-26107919 (SEQ ID NO: 193) | gi-26107926 (SEQ ID NO: 194) | gi-26107942 (SEQ ID NO: 195) |
| gi-26107956 (SEQ ID NO: 196) | gi-26107959 (SEQ ID NO: 197) | gi-26107960 (SEQ ID NO: 198) |
| gi-26107961 (SEQ ID NO: 199) | gi-26107962 (SEQ ID NO: 200) | gi-26108027 (SEQ ID NO: 201) |
| gi-26108028 (SEQ ID NO: 202) | gi-26108030 (SEQ ID NO: 203) | gi-26108031 (SEQ ID NO: 204) |
| gi-26108032 (SEQ ID NO: 205) | gi-26108047 (SEQ ID NO: 206) | gi-26108073 (SEQ ID NO: 207) |
| gi-26108075 (SEQ ID NO: 208) | gi-26108076 (SEQ ID NO: 209) | gi-26108084 (SEQ ID NO: 210) |
| gi-26108096 (SEQ ID NO: 211) | gi-26108136 (SEQ ID NO: 212) | gi-26108146 (SEQ ID NO: 213) |
| gi-26108147 (SEQ ID NO: 214) | gi-26108151 (SEQ ID NO: 215) | gi-26108157 (SEQ ID NO: 216) |
| gi-26108164 (SEQ ID NO: 217) | gi-26108174 (SEQ ID NO: 218) | gi-26108192 (SEQ ID NO: 219) |
| gi-26108193 (SEQ ID NO: 220) | gi-26108194 (SEQ ID NO: 221) | gi-26108196 (SEQ ID NO: 222) |
| gi-26108213 (SEQ ID NO: 223) | gi-26108215 (SEQ ID NO: 224) | gi-26108216 (SEQ ID NO: 225) |
| gi-26108299 (SEQ ID NO: 226) | gi-26108374 (SEQ ID NO: 227) | gi-26108422 (SEQ ID NO: 228) |
| gi-26108563 (SEQ ID NO: 229) | gi-26108639 (SEQ ID NO: 230) | gi-26108640 (SEQ ID NO: 231) |
| gi-26108650 (SEQ ID NO: 232) | gi-26108651 (SEQ ID NO: 233) | gi-26108654 (SEQ ID NO: 234) |
| gi-26108656 (SEQ ID NO: 235) | gi-26108657 (SEQ ID NO: 236) | gi-26108659 (SEQ ID NO: 237) |
| gi-26108660 (SEQ ID NO: 238) | gi-26108662 (SEQ ID NO: 239) | gi-26108663 (SEQ ID NO: 240) |
| gi-26108668 (SEQ ID NO: 241) | gi-26108676 (SEQ ID NO: 242) | gi-26108677 (SEQ ID NO: 243) |
| gi-26108678 (SEQ ID NO: 244) | gi-26108680 (SEQ ID NO: 245) | gi-26108682 (SEQ ID NO: 246) |
| gi-26108683 (SEQ ID NO: 247) | gi-26108684 (SEQ ID NO: 248) | gi-26108686 (SEQ ID NO: 249) |
| gi-26108689 (SEQ ID NO: 250) | gi-26108692 (SEQ ID NO: 251) | gi-26108708 (SEQ ID NO: 252) |
| gi-26108711 (SEQ ID NO: 253) | gi-26108712 (SEQ ID NO: 254) | gi-26108714 (SEQ ID NO: 255) |

TABLE 1-continued

| 599 pathogenic E.coli sequences | | |
|---|---|---|
| gi-26108715 (SEQ ID NO: 256) | gi-26108716 (SEQ ID NO: 257) | gi-26108717 (SEQ ID NO: 258) |
| gi-26108720 (SEQ ID NO: 259) | gi-26108721 (SEQ ID NO: 260) | gi-26108722 (SEQ ID NO: 261) |
| gi-26108723 (SEQ ID NO: 262) | gi-26108724 (SEQ ID NO: 263) | gi-26108725 (SEQ ID NO: 264) |
| gi-26108726 (SEQ ID NO: 265) | gi-26108728 (SEQ ID NO: 266) | gi-26108739 (SEQ ID NO: 267) |
| gi-26108747 (SEQ ID NO: 268) | gi-26108756 (SEQ ID NO: 269) | gi-26108765 (SEQ ID NO: 270) |
| gi-26108768 (SEQ ID NO: 271) | gi-26108769 (SEQ ID NO: 272) | gi-26108770 (SEQ ID NO: 273) |
| gi-26108775 (SEQ ID NO: 274) | gi-26108776 (SEQ ID NO: 275) | gi-26108778 (SEQ ID NO: 276) |
| gi-26108779 (SEQ ID NO: 277) | gi-26108810 (SEQ ID NO: 278) | gi-26108811 (SEQ ID NO: 279) |
| gi-26108813 (SEQ ID NO: 280) | gi-26108816 (SEQ ID NO: 281) | gi-26108817 (SEQ ID NO: 282) |
| gi-26108818 (SEQ ID NO: 283) | gi-26108826 (SEQ ID NO: 284) | gi-26108860 (SEQ ID NO: 285) |
| gi-26108862 (SEQ ID NO: 286) | gi-26108877 (SEQ ID NO: 287) | gi-26108896 (SEQ ID NO: 288) |
| gi-26108898 (SEQ ID NO: 289) | gi-26108915 (SEQ ID NO: 290) | gi-26108952 (SEQ ID NO: 291) |
| gi-26109000 (SEQ ID NO: 292) | gi-26109006 (SEQ ID NO: 293) | gi-26109008 (SEQ ID NO: 294) |
| gi-26109026 (SEQ ID NO: 295) | gi-26109062 (SEQ ID NO: 296) | gi-26109065 (SEQ ID NO: 297) |
| gi-26109126 (SEQ ID NO: 298) | gi-26109127 (SEQ ID NO: 299) | gi-26109128 (SEQ ID NO: 300) |
| gi-26109129 (SEQ ID NO: 301) | gi-26109130 (SEQ ID NO: 302) | gi-26109131 (SEQ ID NO: 303) |
| gi-26109132 (SEQ ID NO: 304) | gi-26109137 (SEQ ID NO: 305) | gi-26109141 (SEQ ID NO: 306) |
| gi-26109143 (SEQ ID NO: 307) | gi-26109160 (SEQ ID NO: 308) | gi-26109178 (SEQ ID NO: 309) |
| gi-26109277 (SEQ ID NO: 310) | gi-26109278 (SEQ ID NO: 311) | gi-26109279 (SEQ ID NO: 312) |
| gi-26109311 (SEQ ID NO: 313) | gi-26109396 (SEQ ID NO: 314) | gi-26109400 (SEQ ID NO: 315) |
| gi-26109404 (SEQ ID NO: 316) | gi-26109406 (SEQ ID NO: 317) | gi-26109409 (SEQ ID NO: 318) |
| gi-26109428 (SEQ ID NO: 319) | gi-26109447 (SEQ ID NO: 320) | gi-26109452 (SEQ ID NO: 321) |
| gi-26109490 (SEQ ID NO: 322) | gi-26109512 (SEQ ID NO: 323) | gi-26109518 (SEQ ID NO: 324) |
| gi-26109519 (SEQ ID NO: 325) | gi-26109522 (SEQ ID NO: 326) | gi-26109548 (SEQ ID NO: 327) |
| gi-26109581 (SEQ ID NO: 328) | gi-26109582 (SEQ ID NO: 329) | gi-26109583 (SEQ ID NO: 330) |
| gi-26109585 (SEQ ID NO: 331) | gi-26109587 (SEQ ID NO: 332) | gi-26109613 (SEQ ID NO: 333) |
| gi-26109629 (SEQ ID NO: 334) | gi-26109630 (SEQ ID NO: 335) | gi-26109631 (SEQ ID NO: 336) |
| gi-26109636 (SEQ ID NO: 337) | gi-26109637 (SEQ ID NO: 338) | gi-26109639 (SEQ ID NO: 339) |
| gi-26109640 (SEQ ID NO: 340) | gi-26109641 (SEQ ID NO: 341) | gi-26109642 (SEQ ID NO: 342) |
| gi-26109643 (SEQ ID NO: 343) | gi-26109645 (SEQ ID NO: 344) | gi-26109647 (SEQ ID NO: 345) |
| gi-26109648 (SEQ ID NO: 346) | gi-26109650 (SEQ ID NO: 347) | gi-26109730 (SEQ ID NO: 348) |
| gi-26109741 (SEQ ID NO: 349) | gi-26109750 (SEQ ID NO: 350) | gi-26109751 (SEQ ID NO: 351) |
| gi-26109753 (SEQ ID NO: 352) | gi-26109760 (SEQ ID NO: 353) | gi-26109761 (SEQ ID NO: 354) |
| gi-26109766 (SEQ ID NO: 355) | gi-26109801 (SEQ ID NO: 356) | gi-26109807 (SEQ ID NO: 357) |
| gi-26109809 (SEQ ID NO: 358) | gi-26109811 (SEQ ID NO: 359) | gi-26109812 (SEQ ID NO: 360) |
| gi-26109813 (SEQ ID NO: 361) | gi-26109816 (SEQ ID NO: 362) | gi-26109817 (SEQ ID NO: 363) |
| gi-26109826 (SEQ ID NO: 364) | gi-26109827 (SEQ ID NO: 365) | gi-26109828 (SEQ ID NO: 366) |
| gi-26109829 (SEQ ID NO: 367) | gi-26109831 (SEQ ID NO: 368) | gi-26109833 (SEQ ID NO: 369) |
| gi-26109834 (SEQ ID NO: 370) | gi-26109835 (SEQ ID NO: 371) | gi-26109837 (SEQ ID NO: 372) |
| gi-26109841 (SEQ ID NO: 373) | gi-26109842 (SEQ ID NO: 374) | gi-26109844 (SEQ ID NO: 375) |
| gi-26109845 (SEQ ID NO: 376) | gi-26109849 (SEQ ID NO: 377) | gi-26109852 (SEQ ID NO: 378) |
| gi-26109853 (SEQ ID NO: 379) | gi-26109855 (SEQ ID NO: 380) | gi-26109861 (SEQ ID NO: 381) |
| gi-26109862 (SEQ ID NO: 382) | gi-26109864 (SEQ ID NO: 383) | gi-26109867 (SEQ ID NO: 384) |
| gi-26109868 (SEQ ID NO: 385) | gi-26109870 (SEQ ID NO: 386) | gi-26109871 (SEQ ID NO: 387) |
| gi-26109873 (SEQ ID NO: 388) | gi-26109877 (SEQ ID NO: 389) | gi-26109878 (SEQ ID NO: 390) |
| gi-26109879 (SEQ ID NO: 391) | gi-26109880 (SEQ ID NO: 392) | gi-26109881 (SEQ ID NO: 393) |
| gi-26109895 (SEQ ID NO: 394) | gi-26109908 (SEQ ID NO: 395) | gi-26109915 (SEQ ID NO: 396) |
| gi-26109927 (SEQ ID NO: 397) | gi-26109928 (SEQ ID NO: 398) | gi-26109930 (SEQ ID NO: 399) |
| gi-26109931 (SEQ ID NO: 400) | gi-26109935 (SEQ ID NO: 401) | gi-26109936 (SEQ ID NO: 402) |
| gi-26109938 (SEQ ID NO: 403) | gi-26109941 (SEQ ID NO: 404) | gi-26109951 (SEQ ID NO: 405) |
| gi-26109955 (SEQ ID NO: 406) | gi-26109956 (SEQ ID NO: 407) | gi-26109957 (SEQ ID NO: 408) |
| gi-26109990 (SEQ ID NO: 409) | gi-26109991 (SEQ ID NO: 410) | gi-26109993 (SEQ ID NO: 411) |
| gi-26109994 (SEQ ID NO: 412) | gi-26109995 (SEQ ID NO: 413) | gi-26110009 (SEQ ID NO: 414) |
| gi-26110010 (SEQ ID NO: 415) | gi-26110011 (SEQ ID NO: 416) | gi-26110012 (SEQ ID NO: 417) |
| gi-26110024 (SEQ ID NO: 418) | gi-26110025 (SEQ ID NO: 419) | gi-26110026 (SEQ ID NO: 420) |
| gi-26110029 (SEQ ID NO: 421) | gi-26110030 (SEQ ID NO: 422) | gi-26110031 (SEQ ID NO: 423) |
| gi-26110032 (SEQ ID NO: 424) | gi-26110033 (SEQ ID NO: 425) | gi-26110145 (SEQ ID NO: 426) |
| gi-26110198 (SEQ ID NO: 427) | gi-26110269 (SEQ ID NO: 428) | gi-26110271 (SEQ ID NO: 429) |
| gi-26110273 (SEQ ID NO: 430) | gi-26110457 (SEQ ID NO: 431) | gi-26110458 (SEQ ID NO: 432) |
| gi-26110460 (SEQ ID NO: 433) | gi-26110461 (SEQ ID NO: 434) | gi-26110462 (SEQ ID NO: 435) |
| gi-26110465 (SEQ ID NO: 436) | gi-26110466 (SEQ ID NO: 437) | gi-26110467 (SEQ ID NO: 438) |
| gi-26110529 (SEQ ID NO: 439) | gi-26110530 (SEQ ID NO: 440) | gi-26110532 (SEQ ID NO: 441) |
| gi-26110559 (SEQ ID NO: 442) | gi-26110564 (SEQ ID NO: 443) | gi-26110568 (SEQ ID NO: 444) |
| gi-26110614 (SEQ ID NO: 445) | gi-26110650 (SEQ ID NO: 446) | gi-26110651 (SEQ ID NO: 447) |
| gi-26110658 (SEQ ID NO: 448) | gi-26110671 (SEQ ID NO: 449) | gi-26110674 (SEQ ID NO: 450) |
| gi-26110675 (SEQ ID NO: 451) | gi-26110685 (SEQ ID NO: 452) | gi-26110699 (SEQ ID NO: 453) |
| gi-26110700 (SEQ ID NO: 454) | gi-26110708 (SEQ ID NO: 455) | gi-26110734 (SEQ ID NO: 456) |
| gi-26110736 (SEQ ID NO: 457) | gi-26110737 (SEQ ID NO: 458) | gi-26110738 (SEQ ID NO: 459) |
| gi-26110745 (SEQ ID NO: 460) | gi-26110746 (SEQ ID NO: 461) | gi-26110747 (SEQ ID NO: 462) |
| gi-26110749 (SEQ ID NO: 463) | gi-26110752 (SEQ ID NO: 464) | gi-26110754 (SEQ ID NO: 465) |
| gi-26110762 (SEQ ID NO: 466) | gi-26110764 (SEQ ID NO: 467) | gi-26110766 (SEQ ID NO: 468) |
| gi-26110768 (SEQ ID NO: 469) | gi-26110769 (SEQ ID NO: 470) | gi-26110776 (SEQ ID NO: 471) |
| gi-26110780 (SEQ ID NO: 472) | gi-26110782 (SEQ ID NO: 473) | gi-26110783 (SEQ ID NO: 474) |
| gi-26110785 (SEQ ID NO: 475) | gi-26110786 (SEQ ID NO: 476) | gi-26110788 (SEQ ID NO: 477) |
| gi-26110789 (SEQ ID NO: 478) | gi-26110794 (SEQ ID NO: 479) | gi-26110797 (SEQ ID NO: 480) |
| gi-26110801 (SEQ ID NO: 481) | gi-26110805 (SEQ ID NO: 482) | gi-26110811 (SEQ ID NO: 483) |
| gi-26110816 (SEQ ID NO: 484) | gi-26110818 (SEQ ID NO: 485) | gi-26110835 (SEQ ID NO: 486) |
| gi-26110844 (SEQ ID NO: 487) | gi-26110856 (SEQ ID NO: 488) | gi-26110866 (SEQ ID NO: 489) |

TABLE 1-continued

| 599 pathogenic E.coli sequences | | |
|---|---|---|
| gi-26110976 (SEQ ID NO: 490) | gi-26110977 (SEQ ID NO: 491) | gi-26110984 (SEQ ID NO: 492) |
| gi-26110987 (SEQ ID NO: 493) | gi-26111004 (SEQ ID NO: 494) | gi-26111005 (SEQ ID NO: 495) |
| gi-26111007 (SEQ ID NO: 496) | gi-26111008 (SEQ ID NO: 497) | gi-26111009 (SEQ ID NO: 498) |
| gi-26111010 (SEQ ID NO: 499) | gi-26111011 (SEQ ID NO: 500) | gi-26111013 (SEQ ID NO: 501) |
| gi-26111014 (SEQ ID NO: 502) | gi-26111016 (SEQ ID NO: 503) | gi-26111024 (SEQ ID NO: 504) |
| gi-26111025 (SEQ ID NO: 505) | gi-26111026 (SEQ ID NO: 506) | gi-26111027 (SEQ ID NO: 507) |
| gi-26111070 (SEQ ID NO: 508) | gi-26111071 (SEQ ID NO: 509) | gi-26111072 (SEQ ID NO: 510) |
| gi-26111073 (SEQ ID NO: 511) | gi-26111074 (SEQ ID NO: 512) | gi-26111075 (SEQ ID NO: 513) |
| gi-26111076 (SEQ ID NO: 514) | gi-26111094 (SEQ ID NO: 515) | gi-26111139 (SEQ ID NO: 516) |
| gi-26111140 (SEQ ID NO: 517) | gi-26111141 (SEQ ID NO: 518) | gi-26111143 (SEQ ID NO: 519) |
| gi-26111166 (SEQ ID NO: 520) | gi-26111169 (SEQ ID NO: 521) | gi-26111170 (SEQ ID NO: 522) |
| gi-26111221 (SEQ ID NO: 523) | gi-26111225 (SEQ ID NO: 524) | gi-26111226 (SEQ ID NO: 525) |
| gi-26111229 (SEQ ID NO: 526) | gi-26111264 (SEQ ID NO: 527) | gi-26111265 (SEQ ID NO: 528) |
| gi-26111266 (SEQ ID NO: 529) | gi-26111270 (SEQ ID NO: 530) | gi-26111272 (SEQ ID NO: 531) |
| gi-26111278 (SEQ ID NO: 532) | gi-26111279 (SEQ ID NO: 533) | gi-26111280 (SEQ ID NO: 534) |
| gi-26111281 (SEQ ID NO: 535) | gi-26111284 (SEQ ID NO: 536) | gi-26111287 (SEQ ID NO: 537) |
| gi-26111294 (SEQ ID NO: 538) | gi-26111301 (SEQ ID NO: 539) | gi-26111302 (SEQ ID NO: 540) |
| gi-26111303 (SEQ ID NO: 541) | gi-26111304 (SEQ ID NO: 542) | gi-26111322 (SEQ ID NO: 543) |
| gi-26111323 (SEQ ID NO: 544) | gi-26111324 (SEQ ID NO: 545) | gi-26111325 (SEQ ID NO: 546) |
| gi-26111394 (SEQ ID NO: 547) | gi-26111395 (SEQ ID NO: 548) | gi-26111398 (SEQ ID NO: 549) |
| gi-26111404 (SEQ ID NO: 550) | gi-26111405 (SEQ ID NO: 551) | gi-26111407 (SEQ ID NO: 552) |
| gi-26111409 (SEQ ID NO: 553) | gi-26111411 (SEQ ID NO: 554) | gi-26111414 (SEQ ID NO: 555) |
| gi-26111418 (SEQ ID NO: 556) | gi-26111419 (SEQ ID NO: 557) | gi-26111420 (SEQ ID NO: 558) |
| gi-26111421 (SEQ ID NO: 559) | gi-26111422 (SEQ ID NO: 560) | gi-26111424 (SEQ ID NO: 561) |
| gi-26111425 (SEQ ID NO: 562) | gi-26111426 (SEQ ID NO: 563) | gi-26111427 (SEQ ID NO: 564) |
| gi-26111428 (SEQ ID NO: 565) | gi-26111431 (SEQ ID NO: 566) | gi-26111441 (SEQ ID NO: 567) |
| gi-26111442 (SEQ ID NO: 568) | gi-26111443 (SEQ ID NO: 569) | gi-26111450 (SEQ ID NO: 570) |
| gi-26111453 (SEQ ID NO: 571) | gi-26111510 (SEQ ID NO: 572) | gi-26111525 (SEQ ID NO: 573) |
| gi-26111536 (SEQ ID NO: 574) | gi-26111537 (SEQ ID NO: 575) | gi-26111542 (SEQ ID NO: 576) |
| gi-26111560 (SEQ ID NO: 577) | gi-26111573 (SEQ ID NO: 578) | gi-26111587 (SEQ ID NO: 579) |
| gi-26111589 (SEQ ID NO: 580) | gi-26111591 (SEQ ID NO: 581) | gi-26111596 (SEQ ID NO: 582) |
| gi-26111597 (SEQ ID NO: 583) | gi-26111612 (SEQ ID NO: 584) | gi-26111614 (SEQ ID NO: 585) |
| gi-26111620 (SEQ ID NO: 586) | gi-26111626 (SEQ ID NO: 587) | gi-26111630 (SEQ ID NO: 588) |
| gi-26111638 (SEQ ID NO: 589) | gi-26111652 (SEQ ID NO: 590) | gi-26111659 (SEQ ID NO: 591) |
| gi-26111660 (SEQ ID NO: 592) | gi-26111670 (SEQ ID NO: 593) | gi-26111671 (SEQ ID NO: 594) |
| gi-26111673 (SEQ ID NO: 595) | gi-26111674 (SEQ ID NO: 596) | gi-26109898 (SEQ ID NO: 597) |
| gi-26108604 (SEQ ID NO: 598) | gi-26109866 (SEQ ID NO: 599) | |

TABLE 2

| 156 preferred antigens | | |
|---|---|---|
| gi-26106323 (SEQ ID NO: 2) | gi-26106348 (SEQ ID NO: 6) | gi-26106390 (SEQ ID NO: 7) |
| gi-26106557 (SEQ ID NO: 23) | gi-26106579 (SEQ ID NO: 25) | gi-26106582 (SEQ ID NO: 26) |
| gi-26106584 (SEQ ID NO: 28) | gi-26106585 (SEQ ID NO: 29) | gi-26106592 (SEQ ID NO: 30) |
| gi-26106594 (SEQ ID NO: 31) | gi-26106595 (SEQ ID NO: 32) | gi-26106601 (SEQ ID NO: 36) |
| gi-26106649 (SEQ ID NO: 49) | gi-26106664 (SEQ ID NO: 57) | gi-26106690 (SEQ ID NO: 59) |
| gi-26106931 (SEQ ID NO: 67) | gi-26107030 (SEQ ID NO: 68) | gi-26107223 (SEQ ID NO: 76) |
| gi-26107228 (SEQ ID NO: 77) | gi-26107241 (SEQ ID NO: 80) | gi-26107246 (SEQ ID NO: 81) |
| gi-26107247 (SEQ ID NO: 82) | gi-26107248 (SEQ ID NO: 83) | gi-26107249 (SEQ ID NO: 84) |
| gi-26107251 (SEQ ID NO: 85) | gi-26107260 (SEQ ID NO: 87) | gi-26107263 (SEQ ID NO: 88) |
| gi-26107265 (SEQ ID NO: 89) | gi-26107309 (SEQ ID NO: 93) | gi-26107393 (SEQ ID NO: 94) |
| gi-26107452 (SEQ ID NO: 96) | gi-26107498 (SEQ ID NO: 112) | gi-26107502 (SEQ ID NO: 114) |
| gi-26107517 (SEQ ID NO: 124) | gi-26107518 (SEQ ID NO: 125) | gi-26107550 (SEQ ID NO: 138) |
| gi-26107554 (SEQ ID NO: 139) | gi-26107666 (SEQ ID NO: 142) | gi-26107673 (SEQ ID NO: 143) |
| gi-26107688 (SEQ ID NO: 145) | gi-26107692 (SEQ ID NO: 147) | gi-26107698 (SEQ ID NO: 149) |
| gi-26107699 (SEQ ID NO: 150) | gi-26107708 (SEQ ID NO: 153) | gi-26107719 (SEQ ID NO: 155) |
| gi-26107739 (SEQ ID NO: 159) | gi-26107741 (SEQ ID NO: 160) | gi-26107751 (SEQ ID NO: 161) |
| gi-26107759 (SEQ ID NO: 165) | gi-26107774 (SEQ ID NO: 167) | gi-26107794 (SEQ ID NO: 170) |
| gi-26107808 (SEQ ID NO: 171) | gi-26107835 (SEQ ID NO: 176) | gi-26107843 (SEQ ID NO: 178) |
| gi-26107851 (SEQ ID NO: 179) | gi-26107855 (SEQ ID NO: 181) | gi-26107861 (SEQ ID NO: 183) |
| gi-26107864 (SEQ ID NO: 184) | gi-26107890 (SEQ ID NO: 188) | gi-26107926 (SEQ ID NO: 194) |
| gi-26107942 (SEQ ID NO: 195) | gi-26107959 (SEQ ID NO: 197) | gi-26107960 (SEQ ID NO: 198) |
| gi-26107961 (SEQ ID NO: 199) | gi-26107962 (SEQ ID NO: 200) | gi-26108028 (SEQ ID NO: 202) |
| gi-26108073 (SEQ ID NO: 207) | gi-26108075 (SEQ ID NO: 208) | gi-26108076 (SEQ ID NO: 209) |
| gi-26108084 (SEQ ID NO: 210) | gi-26108096 (SEQ ID NO: 211) | gi-26108136 (SEQ ID NO: 212) |
| gi-26108216 (SEQ ID NO: 225) | gi-26108422 (SEQ ID NO: 228) | gi-26108650 (SEQ ID NO: 232) |
| gi-26108651 (SEQ ID NO: 233) | gi-26108656 (SEQ ID NO: 235) | gi-26108657 (SEQ ID NO: 236) |
| gi-26108659 (SEQ ID NO: 237) | gi-26108660 (SEQ ID NO: 238) | gi-26108663 (SEQ ID NO: 240) |
| gi-26108668 (SEQ ID NO: 241) | gi-26108779 (SEQ ID NO: 277) | gi-26108811 (SEQ ID NO: 279) |
| gi-26108813 (SEQ ID NO: 280) | gi-26108816 (SEQ ID NO: 281) | gi-26108818 (SEQ ID NO: 283) |
| gi-26108826 (SEQ ID NO: 284) | gi-26108898 (SEQ ID NO: 289) | gi-26108915 (SEQ ID NO: 290) |
| gi-26109141 (SEQ ID NO: 306) | gi-26109160 (SEQ ID NO: 308) | gi-26109178 (SEQ ID NO: 309) |
| gi-26109396 (SEQ ID NO: 314) | gi-26109400 (SEQ ID NO: 315) | gi-26109406 (SEQ ID NO: 317) |
| gi-26109490 (SEQ ID NO: 322) | gi-26109512 (SEQ ID NO: 323) | gi-26109519 (SEQ ID NO: 325) |

TABLE 2-continued

156 preferred antigens

| | | |
|---|---|---|
| gi-26109522 (SEQ ID NO: 326) | gi-26109548 (SEQ ID NO: 327) | gi-26109730 (SEQ ID NO: 348) |
| gi-26109753 (SEQ ID NO: 352) | gi-26109761 (SEQ ID NO: 354) | gi-26109807 (SEQ ID NO: 357) |
| gi-26109809 (SEQ ID NO: 358) | gi-26109811 (SEQ ID NO: 359) | gi-26109831 (SEQ ID NO: 368) |
| gi-26109842 (SEQ ID NO: 374) | gi-26109844 (SEQ ID NO: 375) | gi-26109849 (SEQ ID NO: 377) |
| gi-26109861 (SEQ ID NO: 381) | gi-26109871 (SEQ ID NO: 387) | gi-26109877 (SEQ ID NO: 389) |
| gi-26109878 (SEQ ID NO: 390) | gi-26109879 (SEQ ID NO: 391) | gi-26109908 (SEQ ID NO: 395) |
| gi-26109915 (SEQ ID NO: 396) | gi-26109927 (SEQ ID NO: 397) | gi-26109935 (SEQ ID NO: 401) |
| gi-26109936 (SEQ ID NO: 402) | gi-26109938 (SEQ ID NO: 403) | gi-26109941 (SEQ ID NO: 404) |
| gi-26109956 (SEQ ID NO: 407) | gi-26109994 (SEQ ID NO: 412) | gi-26110029 (SEQ ID NO: 421) |
| gi-26110198 (SEQ ID NO: 427) | gi-26110532 (SEQ ID NO: 441) | gi-26110614 (SEQ ID NO: 445) |
| gi-26110650 (SEQ ID NO: 446) | gi-26110671 (SEQ ID NO: 449) | gi-26110746 (SEQ ID NO: 461) |
| gi-26110762 (SEQ ID NO: 466) | gi-26110764 (SEQ ID NO: 467) | gi-26110766 (SEQ ID NO: 468) |
| gi-26110782 (SEQ ID NO: 473) | gi-26110785 (SEQ ID NO: 475) | gi-26110794 (SEQ ID NO: 479) |
| gi-26110844 (SEQ ID NO: 487) | gi-26110856 (SEQ ID NO: 488) | gi-26110976 (SEQ ID NO: 490) |
| gi-26110977 (SEQ ID NO: 491) | gi-26110987 (SEQ ID NO: 493) | gi-26111303 (SEQ ID NO: 541) |
| gi-26111394 (SEQ ID NO: 547) | gi-26111411 (SEQ ID NO: 554) | gi-26111424 (SEQ ID NO: 561) |
| gi-26111431 (SEQ ID NO: 566) | gi-26111525 (SEQ ID NO: 573) | gi-26111536 (SEQ ID NO: 574) |
| gi-26111542 (SEQ ID NO: 576) | gi-26111573 (SEQ ID NO: 578) | gi-26111614 (SEQ ID NO: 585) |
| gi-26111620 (SEQ ID NO: 586) | gi-28111630 (SEQ ID NO: 588) | gi-26111673 (SEQ ID NO: 595) |

TABLE 3

66 preferred antigens

| | | |
|---|---|---|
| 1 | gi-26106348 (SEQ ID NO: 6) | |
| 2 | gi-26106390 (SEQ ID NO: 7) | + |
| 3 | gi-26106664 (SEQ ID NO: 57) | |
| 4 | gi-26106931 (SEQ ID NO: 67) | + |
| 5 | gi-26107030 (SEQ ID NO: 68) | |
| 6 | gi-26107260 (SEQ ID NO: 87) | |
| 7 | gi-26107452 (SEQ ID NO: 96) | |
| 8 | gi-26107502 (SEQ ID NO: 114) | |
| 9 | gi-26107517 (SEQ ID NO: 124) | + |
| 10 | gi-26107518 (SEQ ID NO: 125) | + |
| 11 | gi-26107666 (SEQ ID NO: 142) | |
| 12 | gi-26107741 (SEQ ID NO: 160) | |
| 13 | gi-26107835 (SEQ ID NO: 176) | + |
| 14 | gi-26107864 (SEQ ID NO: 184) | |
| 15 | gi-26107890 (SEQ ID NO: 188) | |
| 16 | gi-26108075 (SEQ ID NO: 208) | + |
| 17 | gi-26108076 (SEQ ID NO: 209) | |
| 18 | gi-26108084 (SEQ ID NO: 210) | |
| 19 | gi-26108096 (SEQ ID NO: 211) | |
| 20 | gi-26108136 (SEQ ID NO: 212) | |
| 21 | gi-26108216 (SEQ ID NO: 225) | + |
| 22 | gi-26108650 (SEQ ID NO: 232) | + |
| 23 | gi-26108651 (SEQ ID NO: 233) | + |
| 24 | gi-26108656 (SEQ ID NO: 235) | |
| 25 | gi-26108657 (SEQ ID NO: 236) | + |
| 26 | gi-26108659 (SEQ ID NO: 237) | + |
| 27 | gi-26108660 (SEQ ID NO: 238) | |
| 28 | gi-26108668 (SEQ ID NO: 241) | |
| 29 | gi-26108811 (SEQ ID NO: 279) | + |
| 30 | gi-26108813 (SEQ ID NO: 280) | + |
| 31 | gi-26108816 (SEQ ID NO: 281) | |
| 32 | gi-26108818 (SEQ ID NO: 283) | |
| 33 | gi-26109160 (SEQ ID NO: 308) | |
| 34 | gi-26109396 (SEQ ID NO: 314) | |
| 35 | gi-26109519 (SEQ ID NO: 325) | |
| 36 | gi-26109522 (SEQ ID NO: 326) | + |
| 37 | gi-26109548 (SEQ ID NO: 327) | + |
| 38 | gi-26109753 (SEQ ID NO: 352) | |
| 39 | gi-26109761 (SEQ ID NO: 354) | |
| 40 | gi-26109807 (SEQ ID NO: 357) | |
| 41 | gi-26109809 (SEQ ID NO: 358) | |
| 42 | gi-26109831 (SEQ ID NO: 368) | + |
| 43 | gi-26109842 (SEQ ID NO: 374) | |
| 44 | gi-26109844 (SEQ ID NO: 375) | |
| 45 | gi-26109871 (SEQ ID NO: 387) | |
| 46 | gi-26109877 (SEQ ID NO: 389) | + |
| 47 | gi-26109878 (SEQ ID NO: 390) | + |
| 48 | gi-26109941 (SEQ ID NO: 404) | |
| 49 | gi-26109956 (SEQ ID NO: 407) | |
| 50 | gi-26109994 (SEQ ID NO: 412) | |
| 51 | gi-26110029 (SEQ ID NO: 421) | |
| 52 | gi-26110614 (SEQ ID NO: 445) | |
| 53 | gi-26110650 (SEQ ID NO: 446) | |
| 54 | gi-26110746 (SEQ ID NO: 461) | |
| 55 | gi-26110766 (SEQ ID NO: 468) | |
| 56 | gi-26110782 (SEQ ID NO: 473) | |
| 57 | gi-26110844 (SEQ ID NO: 487) | |
| 58 | gi-26110976 (SEQ ID NO: 490) | |
| 59 | gi-26110977 (SEQ ID NO: 491) | |
| 60 | gi-26110987 (SEQ ID NO: 493) | |
| 61 | gi-26111303 (SEQ ID NO: 541) | |
| 62 | gi-26111424 (SEQ ID NO: 561) | |
| 63 | gi-26111536 (SEQ ID NO: 574) | + |
| 64 | gi-26111542 (SEQ ID NO: 576) | |
| 65 | gi-26111630 (SEQ ID NO: 588) | |
| 66 | gi-26111673 (SEQ ID NO: 595) | |

TABLE 4

K12 hits

| SEQ ID | K12 | | | JW3110 | | | DH10B | | |
|---|---|---|---|---|---|---|---|---|---|
| | e value | overlap | % id | e value | overlap | % id | e value | overlap | % id |
| 1 | 1.E−50 | 87/100 | 87 | 4.E−50 | 86/100 | 86 | 7.E−50 | 86/100 | 86 |
| 2 | | | 10 | | | | 1.E−17 | 42/63 | 66 |
| 3 | 2.E−29 | 81/263 | 30 | 2.E−29 | 81/263 | 30 | 7.E−26 | 45/123 | 36 |
| 4 | 1.E−32 | 135/531 | 25 | 1.E−32 | 135/531 | 25 | 2.E−32 | 135/531 | 25 |
| 5 | | | 10 | | | | | | 10 |
| 6 | 5.E−07 | 30/112 | 26 | 5.E−07 | 30/112 | 26 | 8.E−07 | 30/112 | 26 |
| 7 | | | 10 | | | | | | 10 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 8 | | | 10 | | | 10 | | | 10 |
| 9 | | | 10 | | | 10 | | | 10 |
| 10 | | | 10 | | | 10 | | | 10 |
| 11 | 1.E−31 | 86/286 | 30 | 3.E−31 | 85/284 | 29 | 8.E−24 | 60/184 | 32 |
| 12 | 0.E+00 | 540/625 | 86 | 0.E+00 | 540/625 | 86 | 0.E+00 | 526/628 | 83 |
| 13 | e−147 | 259/422 | 61 | e−147 | 259/422 | 61 | e−144 | 224/385 | 58 |
| 14 | 7.E−86 | 152/198 | 76 | 7.E−86 | 152/198 | 76 | 1.E−85 | 152/198 | 76 |
| 15 | 2.E−75 | 142/202 | 70 | 2.E−75 | 142/202 | 70 | 3.E−75 | 142/202 | 70 |
| 16 | 1.E−79 | 144/189 | 76 | 1.E−79 | 144/189 | 76 | 2.E−79 | 144/189 | 76 |
| 17 | 0.E+00 | 750/859 | 87 | 0.E+00 | 750/859 | 87 | 0.E+00 | 750/859 | 87 |
| 18 | e−124 | 210/246 | 85 | e−124 | 210/246 | 85 | e−123 | 210/246 | 85 |
| 19 | 2.E−93 | 169/196 | 86 | 2.E−93 | 169/196 | 86 | 9.E−71 | 140/209 | 66 |
| 20 | 1.E−80 | 143/159 | 89 | 1.E−80 | 143/159 | 89 | 2.E−80 | 143/159 | 89 |
| 21 | | | 10 | | | 10 | 3.E−14 | 33/51 | 64 |
| 22 | 0.E+00 | 672/753 | 89 | 0.E+00 | 672/753 | 89 | 0.E+00 | 418/495 | 84 |
| 23 | | | 10 | | | 10 | | | 10 |
| 24 | | | 10 | | | 10 | | | 10 |
| 25 | | | 10 | | | 10 | 4.E−52 | 104/247 | 42 |
| 26 | | | 10 | | | 10 | | | 10 |
| 27 | | | 10 | | | 10 | | | 10 |
| 28 | | | 10 | | | 10 | | | 10 |
| 29 | 6.E−22 | 51/146 | 34 | 6.E−22 | 51/146 | 34 | 2.E−20 | 53/148 | 35 |
| 30 | | | 10 | | | 10 | | | 10 |
| 31 | | | 10 | | | 10 | | | 10 |
| 32 | | | 10 | | | 10 | | | 10 |
| 33 | 6.E−32 | 167/753 | 22 | 6.E−32 | 167/753 | 22 | 5.E−14 | 91/420 | 21 |
| 34 | 2.E−05 | 42/170 | 24 | 2.E−05 | 42/170 | 24 | | | 10 |
| 35 | 1.E−39 | 108/328 | 32 | 1.E−39 | 108/328 | 32 | 6.E−40 | 109/330 | 33 |
| 36 | | | 10 | | | 10 | | | 10 |
| 37 | 2.E−15 | 95/465 | 20 | 2.E−15 | 95/465 | 20 | 4.E−15 | 95/465 | 20 |
| 38 | | | 10 | | | 10 | | | 10 |
| 39 | | | 10 | | | 10 | | | 10 |
| 40 | | | 10 | | | 10 | | | 10 |
| 41 | | | 10 | | | 10 | | | 10 |
| 42 | | | 10 | | | 10 | | | 10 |
| 43 | | | 10 | | | 10 | | | 10 |
| 44 | 2.E−43 | 96/253 | 37 | 2.E−43 | 96/253 | 37 | 3.E−43 | 96/254 | 37 |
| 45 | 4.E−72 | 148/422 | 35 | 4.E−72 | 148/422 | 35 | 5.E−67 | 141/388 | 36 |
| 46 | 2.E−52 | 122/398 | 30 | 2.E−52 | 122/398 | 30 | 6.E−48 | 93/318 | 29 |
| 47 | 2.E−18 | 260/1249 | 20 | 2.E−18 | 260/1249 | 20 | 7.E−12 | 147/708 | 20 |
| 48 | 1.E−18 | 133/596 | 22 | 1.E−18 | 133/596 | 22 | 2.E−24 | 146/605 | 24 |
| 49 | | | 10 | | | 10 | | | 10 |
| 50 | | | 10 | | | 10 | | | 10 |
| 51 | 7.E−06 | 59/250 | 23 | 7.E−06 | 59/250 | 23 | | | 10 |
| 52 | 2.E−38 | 137/455 | 30 | 2.E−38 | 137/455 | 30 | 1.E−36 | 131/573 | 22 |
| 53 | 1.E−06 | 58/216 | 26 | 1.E−06 | 58/216 | 26 | 4.E−06 | 73/329 | 22 |
| 54 | 2.E−20 | 306/1435 | 21 | 2.E−20 | 306/1435 | 21 | 3.E−19 | 334/1518 | 22 |
| 55 | | | 10 | | | 10 | | | 10 |
| 56 | | | 10 | | | 10 | | | 10 |
| 57 | | | 10 | | | 10 | | | 10 |
| 58 | 2.E−24 | 220/1026 | 21 | 2.E−24 | 220/1026 | 21 | 2.E−20 | 165/740 | 22 |
| 59 | | | 10 | | | 10 | | | 10 |
| 60 | | | 10 | | | 10 | | | 10 |
| 61 | 5.E−23 | 82/266 | 30 | 5.E−23 | 82/266 | 30 | 8.E−23 | 82/266 | 30 |
| 62 | 1.E−59 | 123/298 | 41 | 2.E−59 | 123/298 | 41 | 2.E−59 | 123/298 | 41 |
| 63 | 4.E−49 | 97/223 | 43 | 3.E−36 | 87/254 | 34 | 4.E−54 | 110/258 | 42 |
| 64 | 5.E−49 | 124/431 | 28 | 5.E−49 | 124/431 | 28 | 6.E−45 | 98/295 | 33 |
| 65 | | | 10 | | | 10 | | | 10 |
| 66 | | | 10 | | | 10 | | | 10 |
| 67 | | | 10 | | | 10 | | | 10 |
| 68 | 5.E−06 | 46/189 | 24 | 5.E−06 | 46/189 | 24 | 2.E−05 | 37/149 | 24 |
| 69 | 2.E−12 | 43/149 | 28 | 4.E−12 | 42/146 | 28 | 7.E−12 | 42/146 | 28 |
| 70 | 2.E−79 | 148/237 | 62 | 2.E−79 | 148/237 | 62 | 3.E−79 | 148/237 | 62 |
| 71 | 3.E−30 | 74/227 | 32 | 3.E−30 | 74/227 | 32 | 2.E−27 | 84/260 | 32 |
| 72 | 4.E−38 | 110/379 | 29 | 4.E−38 | 110/379 | 29 | 6.E−38 | 110/379 | 29 |
| 73 | 2.E−50 | 119/324 | 36 | 1.E−50 | 119/324 | 36 | 3.E−50 | 119/324 | 36 |
| 74 | | | 10 | | | 10 | 1.E−09 | 26/34 | 76 |
| 75 | | | 10 | | | 10 | | | 10 |
| 76 | | | 10 | | | 10 | | | 10 |
| 77 | | | 10 | | | 10 | | | 10 |
| 78 | | | 10 | | | 10 | | | 10 |
| 79 | | | 10 | | | 10 | | | 10 |
| 80 | | | 10 | | | 10 | | | 10 |
| 81 | | | 10 | | | 10 | | | 10 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 82 | 3.E−16 | 57/172 | 33 | 3.E−16 | 57/172 | 33 | 5.E−16 | 57/172 | 33 |
| 83 | | | 10 | | | 10 | 0.002 | 24/102 | 23 |
| 84 | | | 10 | | | 10 | | | 10 |
| 85 | | | 10 | | | 10 | | | 10 |
| 86 | | | 10 | | | 10 | | | 10 |
| 87 | 6.E−10 | 84/348 | 24 | 6.E−10 | 84/348 | 24 | 7.E−09 | 44/140 | 31 |
| 88 | | | 10 | | | 10 | | | 10 |
| 89 | | | 10 | | | 10 | | | 10 |
| 90 | 7.E−05 | 48/208 | 23 | 7.E−05 | 48/208 | 23 | 5.E−05 | 52/185 | 28 |
| 91 | | | 10 | | | 10 | | | 10 |
| 92 | 1.E−18 | 37/67 | 55 | 1.E−18 | 37/67 | 55 | 2.E−18 | 37/67 | 55 |
| 93 | | | 10 | | | 10 | 1.E−23 | 55/79 | 69 |
| 94 | | | 10 | | | 10 | 9.E−47 | 85/96 | 88 |
| 95 | | | 10 | | | 10 | | | 10 |
| 96 | 2.E−05 | 17/43 | 39 | 2.E−05 | 17/43 | 39 | | | 10 |
| 97 | e−101 | 191/462 | 41 | e−101 | 191/462 | 41 | e−100 | 191/462 | 41 |
| 98 | | | 10 | | | 10 | | | 10 |
| 99 | 8.E−51 | 92/114 | 80 | 8.E−51 | 92/114 | 80 | 1.E−50 | 92/114 | 80 |
| 100 | 7.E−67 | 160/414 | 38 | 7.E−67 | 160/414 | 38 | 1.E−66 | 160/414 | 38 |
| 101 | 2.E−35 | 102/322 | 31 | 2.E−35 | 102/322 | 31 | 4.E−35 | 102/322 | 31 |
| 102 | | | 10 | | | 10 | | | 10 |
| 103 | | | 10 | | | 10 | | | 10 |
| 104 | | | 10 | | | 10 | | | 10 |
| 105 | | | 10 | | | 10 | 0.001 | 27/84 | 32 |
| 106 | | | 10 | | | 10 | 0.005 | 22/63 | 34 |
| 107 | | | 10 | | | 10 | | | 10 |
| 108 | | | 10 | | | 10 | | | 10 |
| 109 | | | 10 | | | 10 | | | 10 |
| 110 | | | 10 | | | 10 | 3.E−04 | 76/334 | 22 |
| 111 | | | 10 | | | 10 | | | 10 |
| 112 | | | 10 | | | 10 | | | 10 |
| 113 | | | 10 | | | 10 | | | 10 |
| 114 | | | 10 | | | 10 | | | 10 |
| 115 | | | 10 | | | 10 | | | 10 |
| 116 | 8.E−50 | 130/503 | 25 | 8.E−50 | 130/503 | 25 | 1.E−49 | 130/503 | 25 |
| 117 | | | 10 | | | 10 | | | 10 |
| 118 | | | 10 | | | 10 | | | 10 |
| 119 | | | 10 | | | 10 | | | 10 |
| 120 | 4.E−58 | 117/182 | 64 | 4.E−58 | 117/182 | 64 | 2.E−36 | 87/183 | 47 |
| 121 | 8.E−51 | 95/171 | 55 | 8.E−51 | 95/171 | 55 | 7.E−17 | 50/149 | 33 |
| 122 | 6.E−82 | 144/223 | 64 | 6.E−82 | 144/223 | 64 | 8.E−48 | 94/224 | 41 |
| 123 | 0.E+00 | 546/853 | 64 | 0.E+00 | 546/853 | 64 | 0.E+00 | 384/839 | 45 |
| 124 | 8.E−30 | 69/171 | 40 | 8.E−30 | 69/171 | 40 | 4.E−18 | 52/154 | 33 |
| 125 | 6.E−27 | 68/151 | 45 | 6.E−27 | 68/151 | 45 | 5.E−23 | 70/169 | 41 |
| 126 | 0.E+00 | 387/755 | 51 | 0.E+00 | 387/755 | 51 | 0.E+00 | 156/246 | 63 |
| 127 | | | 10 | | | 10 | | | 10 |
| 128 | 4.E−65 | 157/564 | 27 | 4.E−65 | 157/564 | 27 | 8.E−65 | 157/564 | 27 |
| 129 | | | 10 | | | 10 | | | 10 |
| 130 | | | 10 | | | 10 | | | 10 |
| 131 | | | 10 | | | 10 | | | 10 |
| 132 | 1.E−31 | 86/286 | 30 | 3.E−31 | 85/284 | 29 | 8.E−24 | 60/184 | 32 |
| 133 | 4.E−17 | 132/556 | 23 | 4.E−17 | 132/556 | 23 | 7.E−17 | 132/556 | 23 |
| 134 | | | 10 | | | 10 | | | 10 |
| 135 | 1.E−07 | 36/134 | 26 | 1.E−07 | 36/134 | 26 | 2.E−07 | 36/134 | 26 |
| 136 | 5.E−53 | 118/315 | 37 | 5.E−53 | 118/315 | 37 | 9.E−53 | 118/315 | 37 |
| 137 | 0.E+00 | 917/1091 | 84 | 0.E+00 | 897/1039 | 86 | 0.E+00 | 257/288 | 89 |
| 138 | | | 10 | | | 10 | | | 10 |
| 139 | | | 10 | | | 10 | 1.E−55 | 113/264 | 42 |
| 140 | | | 10 | | | 10 | 2.E−16 | 38/43 | 88 |
| 141 | | | 10 | | | 10 | 1.E−15 | 33/43 | 76 |
| 142 | e−133 | 232/262 | 88 | e−133 | 232/262 | 88 | e−133 | 232/262 | 88 |
| 143 | | | 10 | | | 10 | 1.E−93 | 162/181 | 89 |
| 144 | | | 10 | | | 10 | 0.009 | 14/20 | 70 |
| 145 | | | 10 | | | 10 | | | 10 |
| 146 | | | 10 | | | 10 | 6.E−04 | 14/23 | 60 |
| 147 | | | 10 | | | 10 | 3.E−14 | 33/57 | 57 |
| 148 | e−179 | 296/348 | 85 | e−179 | 296/348 | 85 | e−156 | 146/167 | 87 |
| 149 | | | 10 | | | 10 | | | 10 |
| 150 | 6.E−40 | 66/107 | 61 | 6.E−40 | 66/107 | 61 | 1.E−39 | 66/107 | 61 |
| 151 | 8.E−30 | 57/71 | 80 | 8.E−30 | 57/71 | 80 | 1.E−29 | 57/71 | 80 |
| 152 | 3.E−44 | 96/154 | 62 | 1.E−44 | 97/155 | 62 | 2.E−44 | 97/154 | 62 |
| 153 | | | 10 | | | 10 | | | 10 |
| 154 | 2.E−19 | 48/118 | 40 | 2.E−19 | 48/118 | 40 | 1.E−18 | 51/121 | 42 |
| 155 | | | 10 | | | 10 | | | 10 |

TABLE 4-continued

K12 hits

| SEQ ID | K12 | | | JW3110 | | | DH10B | | |
|---|---|---|---|---|---|---|---|---|---|
| | e value | overlap | % id | e value | overlap | % id | e value | overlap | % id |
| 156 | | | 10 | | | 10 | | | 10 |
| 157 | 1.E−06 | 23/42 | 54 | 1.E−06 | 23/42 | 54 | 2.E−06 | 23/42 | 54 |
| 158 | | | 10 | | | 10 | | | 10 |
| 159 | | | 10 | | | 10 | 0.008 | 25/56 | 44 |
| 160 | | | 10 | | | 10 | | | 10 |
| 161 | | | 10 | | | 10 | | | 10 |
| 162 | 8.E−09 | 69/284 | 24 | 1.E−05 | 45/175 | 25 | 1.E−08 | 69/284 | 24 |
| 163 | | | 10 | | | 10 | | | 10 |
| 164 | | | 10 | | | 10 | | | 10 |
| 165 | | | 10 | | | 10 | | | 10 |
| 166 | | | 10 | | | 10 | | | 10 |
| 167 | | | 10 | | | 10 | | | 10 |
| 168 | | | 10 | | | 10 | | | 10 |
| 169 | 1.E−31 | 86/286 | 30 | 3.E−31 | 85/284 | 29 | 8.E−24 | 60/184 | 32 |
| 170 | | | 10 | | | 10 | | | 10 |
| 171 | | | 10 | | | 10 | | | 10 |
| 172 | | | 10 | | | 10 | | | 10 |
| 173 | | | 10 | | | 10 | | | 10 |
| 174 | | | 10 | | | 10 | | | 10 |
| 175 | 1.E−31 | 86/286 | 30 | 3.E−31 | 85/284 | 29 | 8.E−24 | 60/184 | 32 |
| 176 | 5.E−13 | 33/81 | 40 | 5.E−13 | 33/81 | 40 | 8.E−13 | 33/81 | 40 |
| 177 | 8.E−31 | 65/118 | 55 | 8.E−31 | 65/118 | 55 | 1.E−30 | 65/118 | 55 |
| 178 | | | 10 | | | 10 | | | 10 |
| 179 | | | 10 | | | 10 | | | 10 |
| 180 | 1.E−07 | 24/42 | 57 | 1.E−07 | 24/42 | 57 | 2.E−07 | 24/42 | 57 |
| 181 | | | 10 | | | 10 | | | 10 |
| 182 | | | 10 | | | 10 | 0.005 | 18/32 | 56 |
| 183 | | | 10 | | | 10 | 1.E−05 | 33/81 | 40 |
| 184 | | | 10 | | | 10 | | | 10 |
| 185 | 2.E−19 | 64/250 | 25 | 2.E−19 | 64/250 | 25 | 3.E−19 | 64/250 | 25 |
| 186 | 2.E−23 | 63/235 | 26 | 2.E−23 | 63/235 | 26 | 4.E−23 | 63/235 | 26 |
| 187 | 5.E−13 | 59/274 | 21 | 5.E−13 | 59/274 | 21 | 8.E−13 | 59/274 | 21 |
| 188 | | | 10 | | | 10 | 0.002 | 19/31 | 61 |
| 189 | 1.E−11 | 78/262 | 29 | 1.E−11 | 78/262 | 29 | 6.E−14 | 143/685 | 20 |
| 190 | 4.E−32 | 74/238 | 31 | 4.E−32 | 74/238 | 31 | 7.E−32 | 74/238 | 31 |
| 191 | 3.E−46 | 116/278 | 41 | 3.E−46 | 116/278 | 41 | 6.E−46 | 116/278 | 41 |
| 192 | 7.E−06 | 54/229 | 23 | 7.E−06 | 54/229 | 23 | 1.E−05 | 54/229 | 23 |
| 193 | | | 10 | | | 10 | | | 10 |
| 194 | | | 10 | | | 10 | | | 10 |
| 195 | | | 10 | 1.E−23 | 51/92 | 55 | 2.E−23 | 51/92 | 55 |
| 196 | 2.E−26 | 85/314 | 27 | 2.E−26 | 85/314 | 27 | 3.E−26 | 85/314 | 27 |
| 197 | | | 10 | | | 10 | | | 10 |
| 198 | 9.E−07 | 46/194 | 23 | 1.E−06 | 38/158 | 24 | 2.E−06 | 38/158 | 24 |
| 199 | | | 10 | | | 10 | | | 10 |
| 200 | | | 10 | | | 10 | | | 10 |
| 201 | 3.E−95 | 186/362 | 51 | 3.E−95 | 186/362 | 51 | 4.E−95 | 191/383 | 49 |
| 202 | | | 10 | | | 10 | | | 10 |
| 203 | 0.E+00 | 569/1007 | 56 | 0.E+00 | 569/1007 | 56 | 0.E+00 | 546/1003 | 54 |
| 204 | 4.E−74 | 166/456 | 36 | 4.E−74 | 166/456 | 36 | 3.E−71 | 90/190 | 47 |
| 205 | 9.E−50 | 115/382 | 30 | 6.E−47 | 108/367 | 29 | 1.E−33 | 67/184 | 36 |
| 206 | | | 10 | | | 10 | 2.E−27 | 52/65 | 80 |
| 207 | 6.E−17 | 41/54 | 75 | 6.E−17 | 41/54 | 75 | 1.E−16 | 41/54 | 75 |
| 208 | 2.E−12 | 32/86 | 37 | 2.E−12 | 32/86 | 37 | 3.E−12 | 32/86 | 37 |
| 209 | 6.E−09 | 33/124 | 26 | 6.E−09 | 33/124 | 26 | 5.E−08 | 22/56 | 39 |
| 210 | | | 10 | | | 10 | | | 10 |
| 211 | | | 10 | | | 10 | 0.002 | 13/15 | 86 |
| 212 | 2.E−21 | 50/56 | 89 | 2.E−21 | 50/56 | 89 | 4.E−21 | 50/56 | 89 |
| 213 | | | 10 | | | 10 | | | 10 |
| 214 | | | 10 | | | 10 | | | 10 |
| 215 | | | 10 | | | 10 | | | 10 |
| 216 | e−119 | 199/226 | 88 | e−119 | 199/226 | 88 | e−119 | 199/226 | 88 |
| 217 | | | 10 | | | 10 | e−121 | 232/327 | 70 |
| 218 | | | 10 | | | 10 | 1.E−13 | 35/45 | 77 |
| 219 | 0.E+00 | 497/862 | 57 | 0.E+00 | 497/862 | 57 | 0.E+00 | 231/536 | 43 |
| 220 | 1.E−75 | 133/208 | 63 | 1.E−75 | 133/208 | 63 | 1.E−52 | 100/217 | 46 |
| 221 | 4.E−62 | 121/187 | 64 | 4.E−62 | 121/187 | 64 | 6.E−37 | 84/171 | 49 |
| 222 | 2.E−54 | 97/194 | 50 | 2.E−54 | 97/194 | 50 | 3.E−49 | 77/156 | 49 |
| 223 | e−167 | 285/541 | 52 | e−167 | 285/541 | 52 | e−166 | 285/541 | 52 |
| 224 | 1.E−72 | 163/443 | 36 | 1.E−72 | 163/443 | 36 | 2.E−72 | 163/443 | 36 |
| 225 | 2.E−13 | 42/102 | 41 | 2.E−13 | 42/102 | 41 | 3.E−13 | 42/102 | 41 |
| 226 | | | 10 | | | 10 | 3.E−13 | 34/40 | 85 |
| 227 | 9.E−40 | 76/86 | 88 | | | 10 | 2.E−39 | 76/86 | 88 |
| 228 | | | 10 | | | 10 | | | 10 |
| 229 | | | 10 | | | 10 | 9.E−15 | 35/42 | 83 |

TABLE 4-continued

K12 hits

| SEQ ID | K12 e value | K12 overlap | K12 % id | JW3110 e value | JW3110 overlap | JW3110 % id | DH10B e value | DH10B overlap | DH10B % id |
|---|---|---|---|---|---|---|---|---|---|
| 230 | e−108 | 205/382 | 53 | e−108 | 205/382 | 53 | e−114 | 149/247 | 60 |
| 231 | | | 10 | | | 10 | | | 10 |
| 232 | 9.E−05 | 86/394 | 21 | 9.E−05 | 86/394 | 21 | | | 10 |
| 233 | | | 10 | | | 10 | | | 10 |
| 234 | | | 10 | | | 10 | | | 10 |
| 235 | | | 10 | | | 10 | | | 10 |
| 236 | | | 10 | | | 10 | | | 10 |
| 237 | | | 10 | | | 10 | | | 10 |
| 238 | | | 10 | | | 10 | | | 10 |
| 239 | | | 10 | | | 10 | | | 10 |
| 240 | | | 10 | | | 10 | | | 10 |
| 241 | | | 10 | | | 10 | | | 10 |
| 242 | 1.E−20 | 99/376 | 26 | 1.E−20 | 99/376 | 26 | 3.E−20 | 99/376 | 26 |
| 243 | 3.E−60 | 172/595 | 28 | 3.E−60 | 172/595 | 28 | 6.E−60 | 172/595 | 28 |
| 244 | 2.E−60 | 169/578 | 29 | 2.E−60 | 169/578 | 29 | 3.E−60 | 169/578 | 29 |
| 245 | 1.E−57 | 238/911 | 26 | 1.E−57 | 238/911 | 26 | 2.E−21 | 47/142 | 33 |
| 246 | | | 10 | | | 10 | | | 10 |
| 247 | 7.E−26 | 83/277 | 29 | 7.E−26 | 83/277 | 29 | 1.E−25 | 83/277 | 29 |
| 248 | | | 10 | | | 10 | 0.002 | 32/127 | 25 |
| 249 | | | 10 | | | 10 | | | 10 |
| 250 | 4.E−80 | 169/408 | 41 | 4.E−80 | 169/408 | 41 | 7.E−76 | 112/232 | 48 |
| 251 | 2.E−15 | 87/336 | 25 | 2.E−15 | 87/336 | 25 | 3.E−15 | 87/336 | 25 |
| 252 | 2.E−22 | 95/372 | 26 | 2.E−22 | 95/372 | 26 | 3.E−18 | 84/322 | 26 |
| 253 | 1.E−63 | 269/1057 | 25 | 1.E−63 | 269/1057 | 25 | 6.E−28 | 64/193 | 33 |
| 254 | 6.E−17 | 88/436 | 20 | 6.E−17 | 88/436 | 20 | 0.007 | 45/208 | 21 |
| 255 | 3.E−63 | 258/939 | 27 | 3.E−63 | 258/939 | 27 | 6.E−36 | 62/192 | 32 |
| 256 | 8.E−86 | 298/1062 | 28 | 8.E−86 | 298/1062 | 28 | 6.E−47 | 70/191 | 36 |
| 257 | 4.E−27 | 110/434 | 25 | 4.E−27 | 110/434 | 25 | 7.E−27 | 110/434 | 25 |
| 258 | e−102 | 312/1088 | 28 | e−102 | 312/1088 | 28 | 1.E−25 | 80/229 | 34 |
| 259 | 5.E−23 | 84/328 | 25 | 5.E−23 | 84/328 | 25 | 9.E−23 | 84/328 | 25 |
| 260 | | | 10 | | | 10 | | | 10 |
| 261 | | | 10 | | | 10 | | | 10 |
| 262 | 9.E−41 | 97/285 | 34 | 9.E−41 | 97/285 | 34 | 2.E−40 | 97/285 | 34 |
| 263 | 4.E−24 | 109/441 | 24 | 1.E−23 | 108/436 | 24 | 6.E−24 | 109/448 | 24 |
| 264 | 7.E−22 | 67/215 | 31 | 7.E−22 | 67/215 | 31 | 1.E−21 | 67/215 | 31 |
| 265 | 6.E−64 | 249/954 | 26 | 6.E−64 | 249/954 | 26 | 2.E−50 | 64/189 | 33 |
| 266 | | | 10 | | | 10 | | | 10 |
| 267 | | | 10 | | | 10 | | | 10 |
| 268 | | | 10 | | | 10 | | | 10 |
| 269 | | | 10 | | | 10 | | | 10 |
| 270 | | | 10 | | | 10 | | | 10 |
| 271 | 1.E−39 | 108/328 | 32 | 1.E−39 | 108/328 | 32 | 6.E−40 | 109/330 | 33 |
| 272 | 2.E−05 | 42/170 | 24 | 2.E−05 | 42/170 | 24 | | | 10 |
| 273 | 6.E−32 | 167/753 | 22 | 6.E−32 | 167/753 | 22 | 5.E−14 | 91/420 | 21 |
| 274 | | | 10 | | | 10 | | | 10 |
| 275 | | | 10 | | | 10 | | | 10 |
| 276 | 3.E−60 | 102/153 | 66 | 3.E−60 | 102/153 | 66 | 5.E−60 | 102/153 | 66 |
| 277 | | | 10 | | | 10 | 6.E−38 | 80/175 | 45 |
| 278 | 0.E+00 | 338/471 | 71 | 0.E+00 | 338/471 | 71 | 0.E+00 | 198/290 | 68 |
| 279 | | | 10 | | | 10 | | | 10 |
| 280 | | | 10 | | | 10 | | | 10 |
| 281 | | | 10 | | | 10 | | | 10 |
| 282 | | | 10 | | | 10 | | | 10 |
| 283 | 7.E−25 | 98/406 | 24 | 7.E−25 | 98/406 | 24 | 7.E−23 | 82/315 | 26 |
| 284 | | | 10 | | | 10 | 4.E−09 | 24/33 | 72 |
| 285 | | | 10 | | | 10 | | | 10 |
| 286 | | | 10 | | | 10 | | | 10 |
| 287 | | | 10 | | | 10 | | | 10 |
| 288 | 0.E+00 | 520/641 | 81 | 0.E+00 | 408/526 | 77 | 0.E+00 | 776/924 | 83 |
| 289 | | | 10 | | | 10 | 4.E−26 | 60/83 | 72 |
| 290 | | | 10 | | | 10 | 6.E−19 | 43/49 | 87 |
| 291 | e−164 | 277/313 | 88 | e−164 | 277/313 | 88 | e−172 | 295/352 | 83 |
| 292 | | | 10 | | | 10 | 8.E−16 | 36/42 | 85 |
| 293 | | | 10 | | | 10 | 3.E−30 | 60/72 | 83 |
| 294 | | | 10 | | | 10 | e−155 | 177/224 | 79 |
| 295 | 0.E+00 | 1036/1252 | 82 | 0.E+00 | 1036/1252 | 82 | 0.E+00 | 521/682 | 76 |
| 296 | 2.E−78 | 133/153 | 86 | 2.E−78 | 133/153 | 86 | 3.E−78 | 133/153 | 86 |
| 297 | | | 10 | | | 10 | 5.E−14 | 30/37 | 81 |
| 298 | 6.E−75 | 151/295 | 51 | 4.E−73 | 148/290 | 51 | 2.E−74 | 150/295 | 50 |
| 299 | 2.E−67 | 123/152 | 80 | 2.E−67 | 123/152 | 80 | 4.E−67 | 123/152 | 80 |
| 300 | 1.E−51 | 98/162 | 60 | 1.E−51 | 98/162 | 60 | 2.E−51 | 98/162 | 60 |
| 301 | 2.E−57 | 106/167 | 63 | 2.E−57 | 106/167 | 63 | 3.E−57 | 106/167 | 63 |
| 302 | e−107 | 186/250 | 74 | e−107 | 186/250 | 74 | e−107 | 186/250 | 74 |
| 303 | 0.E+00 | 444/578 | 76 | 0.E+00 | 444/578 | 76 | 0.E+00 | 681/883 | 77 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 304 | 4.E−72 | 137/189 | 72 | 4.E−72 | 137/189 | 72 | 7.E−67 | 91/124 | 73 |
| 305 | 0.E+00 | 351/456 | 76 | 0.E+00 | 351/456 | 76 | 0.E+00 | 351/456 | 76 |
| 306 | | | 10 | | | 10 | | | 10 |
| 307 | e−103 | 390/1363 | 28 | e−103 | 390/1363 | 28 | e−131 | 290/918 | 31 |
| 308 | 3.E−43 | 81/91 | 89 | 3.E−43 | 81/91 | 89 | 5.E−43 | 81/91 | 89 |
| 309 | 7.E−51 | 98/114 | 85 | | | 10 | 4.E−53 | 102/119 | 85 |
| 310 | 5.E−05 | 104/439 | 23 | 5.E−05 | 104/439 | 23 | 5.E−06 | 207/951 | 21 |
| 311 | | | 10 | | | 10 | | | 10 |
| 312 | 7.E−71 | 159/458 | 34 | 9.E−71 | 159/458 | 34 | 5.E−67 | 139/378 | 36 |
| 313 | | | 10 | | | 10 | 2.E−06 | 22/37 | 59 |
| 314 | | | 10 | | | 10 | | | 10 |
| 315 | | | 10 | | | 10 | 9.E−09 | 61/152 | 40 |
| 316 | | | 10 | | | 10 | 0.005 | 18/32 | 56 |
| 317 | | | 10 | | | 10 | | | 10 |
| 318 | 1.E−07 | 24/42 | 57 | 1.E−07 | 24/42 | 57 | 2.E−07 | 24/42 | 57 |
| 319 | 1.E−79 | 148/165 | 89 | 3.E−79 | 147/165 | 89 | 5.E−79 | 147/165 | 89 |
| 320 | | | 10 | | | 10 | | | 10 |
| 321 | | | 10 | | | 10 | | | 10 |
| 322 | | | 10 | | | 10 | | | 10 |
| 323 | | | 10 | | | 10 | e−133 | 258/343 | 75 |
| 324 | | | 10 | | | 10 | | | 10 |
| 325 | 5.E−31 | 62/134 | 46 | 5.E−31 | 62/134 | 46 | 8.E−31 | 62/134 | 46 |
| 326 | | | 10 | | | 10 | | | 10 |
| 327 | | | 10 | | | 10 | 0.004 | 25/90 | 27 |
| 328 | | | 10 | | | 10 | 7.E−07 | 23/36 | 63 |
| 329 | | | 10 | | | 10 | | | 10 |
| 330 | 2.E−49 | 115/308 | 37 | 2.E−49 | 115/308 | 37 | 2.E−41 | 100/273 | 36 |
| 331 | 1.E−16 | 46/153 | 30 | 1.E−16 | 46/153 | 30 | 7.E−13 | 36/118 | 30 |
| 332 | e−131 | 224/291 | 76 | e−131 | 224/291 | 76 | e−122 | 209/255 | 81 |
| 333 | | | 10 | | | 10 | 2.E−17 | 40/45 | 88 |
| 334 | | | 10 | | | 10 | | | 10 |
| 335 | | | 10 | | | 10 | | | 10 |
| 336 | 4.E−14 | 40/104 | 38 | 4.E−14 | 40/104 | 38 | 4.E−08 | 45/127 | 35 |
| 337 | | | 10 | | | 10 | | | 10 |
| 338 | | | 10 | | | 10 | | | 10 |
| 339 | | | 10 | | | 10 | | | 10 |
| 340 | | | 10 | | | 10 | | | 10 |
| 341 | | | 10 | | | 10 | | | 10 |
| 342 | | | 10 | | | 10 | | | 10 |
| 343 | | | 10 | | | 10 | 0.006 | 24/88 | 27 |
| 344 | | | 10 | | | 10 | | | 10 |
| 345 | 6.E−30 | 77/250 | 30 | 6.E−30 | 77/250 | 30 | 1.E−29 | 77/250 | 30 |
| 346 | 4.E−44 | 97/184 | 52 | 4.E−44 | 97/184 | 52 | 1.E−36 | 76/148 | 51 |
| 347 | e−115 | 218/523 | 41 | e−115 | 218/523 | 41 | e−115 | 218/523 | 41 |
| 348 | | | 10 | | | 10 | 2.E−15 | 36/49 | 73 |
| 349 | e−165 | 298/343 | 86 | e−165 | 298/343 | 86 | e−145 | 271/343 | 79 |
| 350 | | | 10 | | | 10 | | | 10 |
| 351 | | | 10 | | | 10 | | | 10 |
| 352 | 2.E−23 | 66/215 | 30 | 2.E−23 | 66/215 | 30 | 3.E−23 | 68/209 | 32 |
| 353 | 2.E−11 | 46/158 | 29 | 2.E−11 | 46/158 | 29 | 4.E−11 | 46/158 | 29 |
| 354 | | | 10 | 7.E−10 | 31/46 | 67 | 2.E−15 | 49/101 | 48 |
| 355 | | | 10 | | | 10 | | | 10 |
| 356 | | | 10 | | | 10 | | | 10 |
| 357 | 2.E−23 | 74/229 | 32 | 2.E−23 | 74/229 | 32 | 4.E−23 | 74/229 | 32 |
| 358 | | | 10 | | | 10 | | | 10 |
| 359 | | | 10 | | | 10 | | | 10 |
| 360 | | | 10 | | | 10 | | | 10 |
| 361 | | | 10 | | | 10 | 0.003 | 32/100 | 32 |
| 362 | 2.E−73 | 179/543 | 32 | 2.E−73 | 179/543 | 32 | 3.E−73 | 179/543 | 32 |
| 363 | | | 10 | | | 10 | | | 10 |
| 364 | | | 10 | | | 10 | | | 10 |
| 365 | 4.E−05 | 32/119 | 26 | 4.E−05 | 32/119 | 26 | 3.E−04 | 32/137 | 23 |
| 366 | 2.E−05 | 46/185 | 24 | 2.E−05 | 46/185 | 24 | | | 10 |
| 367 | 3.E−09 | 58/177 | 32 | 3.E−09 | 58/177 | 32 | 4.E−08 | 52/157 | 33 |
| 368 | | | 10 | | | 10 | | | 10 |
| 369 | e−162 | 316/830 | 38 | e−146 | 306/844 | 36 | 0.E+00 | 359/827 | 43 |
| 370 | 3.E−08 | 42/160 | 26 | 3.E−08 | 42/160 | 26 | 6.E−05 | 38/139 | 27 |
| 371 | 2.E−16 | 63/183 | 34 | 2.E−16 | 63/183 | 34 | 2.E−11 | 38/130 | 29 |
| 372 | 3.E−22 | 55/159 | 34 | 3.E−22 | 55/159 | 34 | 6.E−22 | 55/159 | 34 |
| 373 | | | 10 | | | 10 | | | 10 |
| 374 | 6.E−06 | 25/83 | 30 | 6.E−06 | 25/83 | 30 | 1.E−05 | 25/83 | 30 |
| 375 | 2.E−07 | 45/177 | 25 | 2.E−07 | 45/177 | 25 | 3.E−07 | 45/177 | 25 |
| 376 | | | 10 | | | 10 | | | 10 |
| 377 | | | 10 | | | 10 | | | 10 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 378 | | | 10 | | | 10 | | | 10 |
| 379 | 7.E−81 | 214/679 | 31 | 7.E−81 | 214/679 | 31 | 1.E−80 | 214/679 | 31 |
| 380 | 5.E−54 | 108/122 | 88 | 2.E−53 | 107/122 | 87 | | | 10 |
| 381 | | | 10 | | | 10 | | | 10 |
| 382 | 7.E−21 | 212/963 | 22 | 7.E−21 | 212/963 | 22 | 8.E−18 | 179/807 | 22 |
| 383 | | | 10 | | | 10 | | | 10 |
| 384 | | | 10 | | | 10 | | | 10 |
| 385 | | | 10 | | | 10 | | | 10 |
| 386 | | | 10 | | | 10 | | | 10 |
| 387 | 3.E−09 | 86/354 | 24 | 3.E−09 | 86/354 | 24 | 7.E−08 | 96/395 | 24 |
| 388 | e−108 | 176/316 | 55 | e−108 | 176/316 | 55 | e−107 | 176/316 | 55 |
| 389 | 6.E−99 | 159/348 | 45 | 6.E−99 | 159/348 | 45 | 1.E−98 | 159/348 | 45 |
| 390 | 2.E−87 | 144/235 | 61 | 2.E−87 | 144/235 | 61 | 4.E−87 | 144/235 | 61 |
| 391 | | | 10 | | | 10 | | | 10 |
| 392 | 0.E+00 | 316/472 | 66 | 0.E+00 | 316/472 | 66 | e−170 | 273/410 | 66 |
| 393 | 4.E−79 | 152/284 | 53 | 4.E−79 | 152/284 | 53 | 7.E−79 | 152/284 | 53 |
| 394 | e−138 | 241/456 | 52 | e−138 | 241/456 | 52 | e−138 | 241/456 | 52 |
| 395 | | | 10 | | | 10 | | | 10 |
| 396 | | | 10 | | | 10 | 4.E−51 | 94/107 | 87 |
| 397 | | | 10 | | | 10 | | | 10 |
| 398 | | | 10 | | | 10 | | | 10 |
| 399 | | | 10 | | | 10 | 0.004 | 43/246 | 17 |
| 400 | 2.E−08 | 54/204 | 26 | 2.E−08 | 54/204 | 26 | | | 10 |
| 401 | | | 10 | | | 10 | | | 10 |
| 402 | | | 10 | | | 10 | | | 10 |
| 403 | | | 10 | | | 10 | | | 10 |
| 404 | 5.E−06 | 34/156 | 21 | 5.E−06 | 34/156 | 21 | | | 10 |
| 405 | 2.E−26 | 137/573 | 23 | 2.E−26 | 137/573 | 23 | 2.E−21 | 91/374 | 24 |
| 406 | 2.E−39 | 100/356 | 28 | 2.E−39 | 100/356 | 28 | 2.E−39 | 104/376 | 27 |
| 407 | 3.E−25 | 97/340 | 28 | 3.E−25 | 97/340 | 28 | 6.E−25 | 97/340 | 28 |
| 408 | 8.E−55 | 100/184 | 54 | 8.E−55 | 100/184 | 54 | 1.E−54 | 100/184 | 54 |
| 409 | e−122 | 232/464 | 50 | e−122 | 232/464 | 50 | e−121 | 232/475 | 48 |
| 410 | e−108 | 189/338 | 55 | e−108 | 189/338 | 55 | 1.E−44 | 108/341 | 31 |
| 411 | 5.E−33 | 89/327 | 27 | 5.E−33 | 89/327 | 27 | 9.E−33 | 89/327 | 27 |
| 412 | 1.E−06 | 32/154 | 20 | 1.E−06 | 32/154 | 20 | | | 10 |
| 413 | 4.E−77 | 151/414 | 36 | 4.E−77 | 151/414 | 36 | 3.E−79 | 154/423 | 36 |
| 414 | 2.E−10 | 51/206 | 24 | 2.E−10 | 51/206 | 24 | 4.E−10 | 51/206 | 24 |
| 415 | 3.E−08 | 60/221 | 27 | 3.E−08 | 60/221 | 27 | 6.E−05 | 46/162 | 28 |
| 416 | 2.E−42 | 102/313 | 32 | 2.E−42 | 102/313 | 32 | 3.E−42 | 102/313 | 32 |
| 417 | 4.E−53 | 127/321 | 39 | 4.E−53 | 127/321 | 39 | 4.E−53 | 128/324 | 39 |
| 418 | | | 10 | | | 10 | | | 10 |
| 419 | 7.E−14 | 64/227 | 28 | 7.E−14 | 64/227 | 28 | 3.E−13 | 62/221 | 28 |
| 420 | 2.E−09 | 40/126 | 31 | 2.E−09 | 40/126 | 31 | 3.E−09 | 40/126 | 31 |
| 421 | | | 10 | | | 10 | 2.E−18 | 40/59 | 67 |
| 422 | 1.E−54 | 110/185 | 59 | 1.E−54 | 110/185 | 59 | 3.E−50 | 103/172 | 59 |
| 423 | 0.E+00 | 451/803 | 56 | 0.E+00 | 348/818 | 42 | 0.E+00 | 453/803 | 56 |
| 424 | 2.E−68 | 117/227 | 51 | 2.E−68 | 117/227 | 51 | 1.E−63 | 99/196 | 50 |
| 425 | 1.E−59 | 134/357 | 37 | 1.E−59 | 134/357 | 37 | 7.E−55 | 119/313 | 38 |
| 426 | 2.E−58 | 113/257 | 43 | 2.E−58 | 113/257 | 43 | 3.E−58 | 113/258 | 43 |
| 427 | | | 10 | | | 10 | 1.E−36 | 75/107 | 70 |
| 428 | 3.E−63 | 133/312 | 42 | 3.E−63 | 133/312 | 42 | 6.E−63 | 133/312 | 42 |
| 429 | 9.E−36 | 95/292 | 32 | 9.E−36 | 95/292 | 32 | 2.E−35 | 95/292 | 32 |
| 430 | | | 10 | | | 10 | | | 10 |
| 431 | | | 10 | | | 10 | | | 10 |
| 432 | | | 10 | | | 10 | | | 10 |
| 433 | 1.E−14 | 45/163 | 27 | 1.E−14 | 45/163 | 27 | 1.E−12 | 57/223 | 25 |
| 434 | 2.E−37 | 84/227 | 37 | 2.E−37 | 84/227 | 37 | 4.E−37 | 84/227 | 37 |
| 435 | 2.E−17 | 59/183 | 32 | 2.E−17 | 59/183 | 32 | 4.E−17 | 59/183 | 32 |
| 436 | 0.E+00 | 404/834 | 48 | 0.E+00 | 404/834 | 48 | 0.E+00 | 256/536 | 47 |
| 437 | 2.E−53 | 102/224 | 45 | 2.E−53 | 102/224 | 45 | 4.E−43 | 88/218 | 40 |
| 438 | 6.E−11 | 53/180 | 29 | 6.E−11 | 53/180 | 29 | 1.E−10 | 53/180 | 29 |
| 439 | 9.E−13 | 33/93 | 35 | 9.E−13 | 33/93 | 35 | 1.E−12 | 33/93 | 35 |
| 440 | e−100 | 178/437 | 40 | e−100 | 178/437 | 40 | 2.E−99 | 178/437 | 40 |
| 441 | | | 10 | | | 10 | | | 10 |
| 442 | 1.E−29 | 172/695 | 24 | 1.E−29 | 172/695 | 24 | 2.E−29 | 172/695 | 24 |
| 443 | 2.E−22 | 67/220 | 30 | 2.E−22 | 67/220 | 30 | 4.E−22 | 67/220 | 30 |
| 444 | 2.E−55 | 126/321 | 39 | 2.E−55 | 126/321 | 39 | 4.E−54 | 117/284 | 41 |
| 445 | | | 10 | | | 10 | 3.E−43 | 83/100 | 83 |
| 446 | 5.E−61 | 112/149 | 75 | 5.E−61 | 112/149 | 75 | 2.E−56 | 63/74 | 85 |
| 447 | 0.E+00 | 339/390 | 86 | 0.E+00 | 339/390 | 86 | 0.E+00 | 361/425 | 84 |
| 448 | | | 10 | | | 10 | e−107 | 182/230 | 79 |
| 449 | | | 10 | | | 10 | 3.E−64 | 113/136 | 83 |
| 450 | | | 10 | | | 10 | | | 10 |
| 451 | 3.E−17 | 244/1144 | 21 | 3.E−17 | 244/1144 | 21 | 1.E−13 | 157/679 | 23 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 452 | | | 10 | | | 10 | 8.E−35 | 67/87 | 77 |
| 453 | 1.E−44 | 115/390 | 29 | 1.E−44 | 115/390 | 29 | 2.E−44 | 117/394 | 29 |
| 454 | 3.E−18 | 46/139 | 33 | 3.E−18 | 46/139 | 33 | 4.E−14 | 24/72 | 33 |
| 455 | e−143 | 243/332 | 73 | e−143 | 243/332 | 73 | e−148 | 251/344 | 72 |
| 456 | 9.E−69 | 126/305 | 41 | 3.E−68 | 123/296 | 41 | 2.E−68 | 126/305 | 41 |
| 457 | 2.E−36 | 96/280 | 34 | 2.E−36 | 96/280 | 34 | 7.E−36 | 87/232 | 37 |
| 458 | 2.E−75 | 142/328 | 43 | 2.E−75 | 142/328 | 43 | 3.E−75 | 142/328 | 43 |
| 459 | 2.E−23 | 51/99 | 51 | 2.E−23 | 51/99 | 51 | 4.E−23 | 51/99 | 51 |
| 460 | | | 10 | | | 10 | | | 10 |
| 461 | 2.E−22 | 91/347 | 26 | 2.E−22 | 91/347 | 26 | 7.E−18 | 86/330 | 26 |
| 462 | e−103 | 177/416 | 42 | e−103 | 177/416 | 42 | e−103 | 177/416 | 42 |
| 463 | 2.E−31 | 103/382 | 26 | 2.E−31 | 103/382 | 26 | 3.E−31 | 103/382 | 26 |
| 464 | 6.E−95 | 184/480 | 38 | 6.E−95 | 184/480 | 38 | 1.E−94 | 184/480 | 38 |
| 465 | 3.E−89 | 169/470 | 35 | 3.E−89 | 169/470 | 35 | 6.E−89 | 169/470 | 35 |
| 466 | | | 10 | | | 10 | | | 10 |
| 467 | | | 10 | | | 10 | | | 10 |
| 468 | | | 10 | | | 10 | | | 10 |
| 469 | | | 10 | | | 10 | | | 10 |
| 470 | | | 10 | | | 10 | | | 10 |
| 471 | 2.E−43 | 98/237 | 41 | 2.E−43 | 98/237 | 41 | 4.E−43 | 98/237 | 41 |
| 472 | e−115 | 203/392 | 51 | e−115 | 203/392 | 51 | e−112 | 185/345 | 53 |
| 473 | 3.E−13 | 32/47 | 68 | 3.E−13 | 32/47 | 68 | 5.E−13 | 32/47 | 68 |
| 474 | 1.E−07 | 52/206 | 25 | 1.E−07 | 52/206 | 25 | 2.E−07 | 52/206 | 25 |
| 475 | | | 10 | | | 10 | | | 10 |
| 476 | 3.E−15 | 56/188 | 29 | 3.E−15 | 56/188 | 29 | 5.E−15 | 56/188 | 29 |
| 477 | 2.E−54 | 110/268 | 41 | 2.E−54 | 110/268 | 41 | 3.E−54 | 110/268 | 41 |
| 478 | | | 10 | | | 10 | | | 10 |
| 479 | | | 10 | | | 10 | | | 10 |
| 480 | e−143 | 243/382 | 63 | e−143 | 243/382 | 63 | e−142 | 243/382 | 63 |
| 481 | e−128 | 215/344 | 62 | e−128 | 215/344 | 62 | e−128 | 215/344 | 62 |
| 482 | | | 10 | | | 10 | | | 10 |
| 483 | | | 10 | | | 10 | | | 10 |
| 484 | 3.E−40 | 97/226 | 42 | 3.E−40 | 97/226 | 42 | 2.E−20 | 49/89 | 55 |
| 485 | | | 10 | | | 10 | | | 10 |
| 486 | | | 10 | 5.E−46 | 87/97 | 89 | 4.E−56 | 105/120 | 87 |
| 487 | | | 10 | | | 10 | | | 10 |
| 488 | | | 10 | | | 10 | 3.E−18 | 41/52 | 78 |
| 489 | 1.E−38 | 73/118 | 61 | 1.E−38 | 73/118 | 61 | 9.E−49 | 92/143 | 64 |
| 490 | | | 10 | | | 10 | 5.E−07 | 27/36 | 75 |
| 491 | | | 10 | | | 10 | 1.E−15 | 34/47 | 72 |
| 492 | | | 10 | | | 10 | | | 10 |
| 493 | | | 10 | | | 10 | | | 10 |
| 494 | 2.E−27 | 55/82 | 67 | 2.E−27 | 55/82 | 67 | 4.E−27 | 55/82 | 67 |
| 495 | | | 10 | | | 10 | | | 10 |
| 496 | e−105 | 213/487 | 43 | e−105 | 213/487 | 43 | e−105 | 213/487 | 43 |
| 497 | 0.E+00 | 452/658 | 68 | 0.E+00 | 452/659 | 68 | 0.E+00 | 434/663 | 65 |
| 498 | 3.E−17 | 64/268 | 23 | 3.E−17 | 64/268 | 23 | 5.E−15 | 62/273 | 22 |
| 499 | 4.E−49 | 101/294 | 34 | 4.E−49 | 101/294 | 34 | 5.E−46 | 97/282 | 34 |
| 500 | 3.E−31 | 106/400 | 26 | 3.E−31 | 106/400 | 26 | | | 10 |
| 501 | 2.E−75 | 155/319 | 48 | 2.E−75 | 155/319 | 48 | 8.E−69 | 123/232 | 53 |
| 502 | e−119 | 216/466 | 46 | e−119 | 216/466 | 46 | e−115 | 214/461 | 46 |
| 503 | e−100 | 214/511 | 41 | e−100 | 214/511 | 41 | 2.E−94 | 134/277 | 48 |
| 504 | | | 10 | | | 10 | | | 10 |
| 505 | | | 10 | | | 10 | | | 10 |
| 506 | | | 10 | | | 10 | | | 10 |
| 507 | 5.E−31 | 83/202 | 41 | 5.E−31 | 83/202 | 41 | 3.E−44 | 91/195 | 46 |
| 508 | e−103 | 186/260 | 71 | e−103 | 186/260 | 71 | e−103 | 186/260 | 71 |
| 509 | e−112 | 199/297 | 67 | e−112 | 199/297 | 67 | e−107 | 106/154 | 68 |
| 510 | e−118 | 211/292 | 72 | e−118 | 211/292 | 72 | e−118 | 130/181 | 71 |
| 511 | e−108 | 194/288 | 67 | e−108 | 194/288 | 67 | e−102 | 171/258 | 66 |
| 512 | 2.E−34 | 99/316 | 31 | 2.E−34 | 99/316 | 31 | 3.E−34 | 99/316 | 31 |
| 513 | 9.E−26 | 112/428 | 26 | 9.E−26 | 112/428 | 26 | 6.E−22 | 91/377 | 24 |
| 514 | 9.E−97 | 175/424 | 41 | 9.E−97 | 175/424 | 41 | 2.E−96 | 175/424 | 41 |
| 515 | | | 10 | | | 10 | | | 10 |
| 516 | e−106 | 169/262 | 64 | e−106 | 169/262 | 64 | e−106 | 169/262 | 64 |
| 517 | 2.E−19 | 140/630 | 22 | 2.E−19 | 140/630 | 22 | 3.E−19 | 140/630 | 22 |
| 518 | 9.E−30 | 132/525 | 25 | 9.E−30 | 132/525 | 25 | 2.E−18 | 120/566 | 21 |
| 519 | 8.E−25 | 121/497 | 24 | 8.E−25 | 121/497 | 24 | 5.E−21 | 119/542 | 21 |
| 520 | e−137 | 239/427 | 55 | e−137 | 239/427 | 55 | 7.E−58 | 74/198 | 37 |
| 521 | 1.E−34 | 121/426 | 28 | 1.E−34 | 121/426 | 28 | 3.E−34 | 121/426 | 28 |
| 522 | 1.E−56 | 138/416 | 33 | 1.E−56 | 138/416 | 33 | 9.E−52 | 128/428 | 29 |
| 523 | | | 10 | | | 10 | | | 10 |
| 524 | 1.E−96 | 170/272 | 62 | 1.E−96 | 170/272 | 62 | 5.E−91 | 137/205 | 66 |
| 525 | 6.E−92 | 160/252 | 63 | 6.E−92 | 160/252 | 63 | 5.E−78 | 115/172 | 66 |

TABLE 4-continued

| | K12 hits | | | | | | | | |
|---|---|---|---|---|---|---|---|---|---|
| SEQ | K12 | | | JW3110 | | | DH10B | | |
| ID | e value | overlap | % id | e value | overlap | % id | e value | overlap | % id |
| 526 | 3.E−30 | 90/271 | 33 | 3.E−30 | 90/271 | 33 | 3.E−29 | 88/271 | 32 |
| 527 | 2.E−07 | 107/560 | 19 | 2.E−07 | 107/560 | 19 | | | 10 |
| 528 | 1.E−79 | 156/420 | 37 | 1.E−79 | 156/420 | 37 | 7.E−64 | 144/420 | 34 |
| 529 | 2.E−35 | 88/254 | 34 | 2.E−35 | 88/254 | 34 | 4.E−35 | 88/254 | 34 |
| 530 | | | 10 | | | 10 | | | 10 |
| 531 | 2.E−15 | 47/204 | 23 | 2.E−15 | 47/204 | 23 | 3.E−15 | 47/204 | 23 |
| 532 | 1.E−77 | 176/458 | 38 | 1.E−77 | 176/458 | 38 | 1.E−61 | 112/289 | 38 |
| 533 | e−115 | 216/386 | 55 | e−115 | 216/386 | 55 | e−114 | 216/386 | 55 |
| 534 | e−116 | 196/290 | 67 | e−116 | 196/290 | 67 | e−116 | 196/290 | 67 |
| 535 | 2.E−39 | 134/486 | 27 | 2.E−39 | 134/486 | 27 | 1.E−38 | 126/430 | 29 |
| 536 | 1.E−20 | 62/231 | 26 | 1.E−20 | 62/231 | 26 | 4.E−13 | 97/410 | 23 |
| 537 | | | | | | 10 | 6.E−08 | 23/35 | 65 |
| 538 | | | 10 | | | 10 | 9.E−18 | 37/44 | 84 |
| 539 | 5.E−27 | 79/275 | 28 | 5.E−27 | 79/275 | 28 | 5.E−26 | 73/241 | 30 |
| 540 | | | 10 | | | 10 | | | 10 |
| 541 | 2.E−12 | 36/109 | 33 | 2.E−12 | 36/109 | 33 | 3.E−12 | 36/109 | 33 |
| 542 | 7.E−33 | 77/224 | 34 | 7.E−33 | 77/224 | 34 | 1.E−32 | 77/224 | 34 |
| 543 | 2.E−47 | 109/277 | 39 | 2.E−47 | 109/277 | 39 | 3.E−46 | 110/263 | 41 |
| 544 | 4.E−66 | 121/266 | 45 | 3.E−66 | 121/266 | 45 | 6.E−66 | 121/266 | 45 |
| 545 | 5.E−71 | 145/332 | 43 | 5.E−71 | 145/332 | 43 | 1.E−70 | 145/332 | 43 |
| 546 | 2.E−42 | 146/504 | 28 | 2.E−42 | 146/504 | 28 | 3.E−41 | 144/502 | 28 |
| 547 | | | 10 | | | 10 | 1.E−31 | 63/129 | 48 |
| 548 | 2.E−59 | 100/137 | 72 | 2.E−59 | 100/137 | 72 | 3.E−59 | 100/137 | 72 |
| 549 | | | 10 | | | 10 | | | 10 |
| 550 | | | 10 | | | 10 | | | 10 |
| 551 | | | 10 | | | 10 | | | 10 |
| 552 | 7.E−22 | 67/217 | 30 | 2.E−21 | 66/215 | 30 | 1.E−17 | 42/118 | 35 |
| 553 | | | 10 | | | | | | 10 |
| 554 | | | 10 | | | 10 | 0.006 | 15/43 | 34 |
| 555 | e−103 | 254/698 | 36 | e−103 | 254/698 | 36 | e−103 | 254/698 | 36 |
| 556 | 5.E−31 | 84/286 | 29 | 2.E−30 | 83/284 | 29 | 8.E−24 | 60/184 | 32 |
| 557 | | | 10 | | | | | | 10 |
| 558 | 4.E−05 | 32/119 | 26 | 4.E−05 | 32/119 | 26 | 3.E−04 | 32/137 | 23 |
| 559 | 2.E−05 | 46/185 | 24 | 2.E−05 | 46/185 | 24 | | | 10 |
| 560 | 3.E−09 | 58/177 | 32 | 3.E−09 | 58/177 | 32 | 4.E−08 | 52/157 | 33 |
| 561 | | | 10 | | | | | | 10 |
| 562 | 3.E−51 | 99/243 | 40 | 3.E−51 | 99/243 | 40 | 5.E−51 | 99/243 | 40 |
| 563 | e−162 | 316/830 | 38 | e−146 | 306/844 | 36 | 0.E+00 | 359/827 | 43 |
| 564 | 3.E−08 | 42/160 | 26 | 3.E−08 | 42/160 | 26 | 6.E−05 | 38/139 | 27 |
| 565 | 9.E−15 | 60/182 | 32 | 9.E−15 | 60/182 | 32 | 7.E−12 | 50/184 | 27 |
| 566 | | | 10 | | | 10 | | | 10 |
| 567 | 3.E−85 | 169/437 | 38 | 3.E−85 | 169/437 | 38 | 5.E−85 | 169/437 | 38 |
| 568 | | | 10 | | | 10 | | | 10 |
| 569 | 2.E−18 | 58/215 | 26 | 2.E−18 | 58/215 | 26 | 2.E−13 | 50/195 | 25 |
| 570 | | | 10 | | | 10 | | | 10 |
| 571 | 7.E−31 | 85/286 | 29 | 2.E−30 | 84/284 | 29 | 6.E−24 | 65/202 | 32 |
| 572 | | | 10 | | | 10 | 3.E−22 | 43/49 | 87 |
| 573 | | | 10 | | | 10 | e−114 | 196/221 | 88 |
| 574 | | | 10 | | | 10 | | | 10 |
| 575 | e−122 | 200/424 | 47 | e−122 | 200/424 | 47 | e−122 | 200/424 | 47 |
| 576 | 7.E−24 | 75/255 | 29 | 7.E−24 | 75/255 | 29 | 1.E−23 | 75/255 | 29 |
| 577 | 3.E−47 | 107/304 | 35 | 3.E−47 | 107/304 | 35 | 5.E−47 | 107/304 | 35 |
| 578 | | | 10 | | | 10 | 9.E−40 | 91/126 | 72 |
| 579 | 3.E−63 | 145/495 | 29 | 3.E−63 | 145/495 | 29 | 7.E−35 | 86/326 | 26 |
| 580 | 1.E−84 | 164/298 | 55 | 1.E−84 | 164/298 | 55 | 1.E−82 | 161/295 | 54 |
| 581 | | | 10 | | | 10 | | | 10 |
| 582 | 2.E−35 | 71/132 | 53 | 2.E−35 | 71/132 | 53 | 3.E−34 | 70/131 | 53 |
| 583 | 9.E−43 | 85/227 | 37 | 9.E−43 | 85/227 | 37 | 2.E−42 | 85/227 | 37 |
| 584 | | | 10 | | | 10 | | | 10 |
| 585 | | | 10 | | | 10 | | | 10 |
| 586 | | | 10 | | | 10 | 0.006 | 17/50 | 34 |
| 587 | | | 10 | | | 10 | | | 10 |
| 588 | | | 10 | | | 10 | 1.E−48 | 103/138 | 74 |
| 589 | | | 10 | | | 10 | 7.E−04 | 22/42 | 52 |
| 590 | | | 10 | | | 10 | | | 10 |
| 591 | e−105 | 185/294 | 62 | e−105 | 185/294 | 62 | e−105 | 185/294 | 62 |
| 592 | | | 10 | | | 10 | | | 10 |
| 593 | 2.E−66 | 130/414 | 31 | 2.E−66 | 130/414 | 31 | 1.E−67 | 136/419 | 32 |
| 594 | 5.E−08 | 27/95 | 28 | 5.E−08 | 27/95 | 28 | 5.E−06 | 22/74 | 29 |
| 595 | | | 10 | | | 10 | | | 10 |
| 596 | e−179 | 321/549 | 58 | e−179 | 321/549 | 58 | 2.E−96 | 181/334 | 54 |
| 597 | 0 | 927/1041 | 89 | 0 | 891/1040 | 89 | 0 | 267/288 | 92 |

TABLE 4-continued

K12 hits

| SEQ ID | K12 e value | K12 overlap | K12 % id | JW3110 e value | JW3110 overlap | JW3110 % id | DH10B e value | DH10B overlap | DH10B % id |
|---|---|---|---|---|---|---|---|---|---|
| 598 | 1.E−175 | 295/329 | 89 | 1.00e0175 | 295/329 | 89 | 1.E−174 | 395/329 | 89 |
| 599 | 3.00E−12 | 146/711 | 20 | 3.00e−12 | 146/711 | 20 | 5.00E−12 | 146/711 | 20 |

A blank box indicates no hit above 10% identity in that strain

TABLE 5

SEQ ID NOs with strongest inter-UPEC hits

<u>1</u>, <u>3</u>, <u>4</u>, <u>6</u>, <u>7</u>, 11, <u>12</u>, 13, 14, 15, 16, <u>17</u>, 18, 19, <u>20</u>, <u>22</u>,
<u>24</u>, <u>33</u>, <u>34</u>, <u>35</u>, <u>37</u>, <u>41</u>, <u>42</u>, 44, <u>45</u>, <u>46</u>, <u>47</u>, <u>48</u>, <u>50</u>, <u>51</u>, <u>52</u>, <u>53</u>,
<u>54</u>, <u>55</u>, <u>56</u>, <u>57</u>, <u>58</u>, <u>60</u>, 61, 62, 63, <u>64</u>, 65, <u>67</u>, <u>68</u>, <u>69</u>, 70, 71,
<u>72</u>, <u>73</u>, <u>75</u>, <u>82</u>, <u>87</u>, <u>96</u>, <u>97</u>, <u>99</u>, <u>100</u>, <u>101</u>, <u>106</u>, <u>110</u>, 111, <u>114</u>, <u>115</u>, <u>116</u>,
117, <u>118</u>, <u>119</u>, <u>120</u>, <u>121</u>, 122, <u>123</u>, <u>124</u>, <u>125</u>, <u>126</u>, <u>127</u>, <u>128</u>, <u>129</u>, <u>130</u>, <u>131</u>, 132,
<u>133</u>, 134, <u>135</u>, <u>136</u>, <u>137</u>, <u>140</u>, 142, <u>151</u>, <u>152</u>, 154, <u>156</u>, <u>157</u>, <u>158</u>, <u>160</u>, <u>162</u>, 169,
175, <u>176</u>, <u>177</u>, <u>180</u>, 182, <u>184</u>, 185, 186, 187, <u>188</u>, <u>189</u>, 190, 191, <u>192</u>, <u>194</u>, <u>195</u>,
<u>196</u>, <u>201</u>, <u>203</u>, <u>204</u>, <u>205</u>, <u>208</u>, <u>209</u>, <u>210</u>, <u>211</u>, <u>212</u>, <u>214</u>, <u>215</u>, 216, <u>219</u>, <u>220</u>, <u>221</u>,
222, <u>223</u>, <u>224</u>, <u>225</u>, <u>227</u>, <u>230</u>, <u>232</u>, <u>233</u>, 234, 235, 236, <u>237</u>, <u>238</u>, <u>239</u>, <u>241</u>, <u>242</u>,
<u>243</u>, <u>244</u>, <u>245</u>, <u>246</u>, <u>247</u>, <u>248</u>, <u>249</u>, <u>250</u>, <u>251</u>, <u>252</u>, <u>253</u>, <u>254</u>, <u>255</u>, <u>256</u>, <u>257</u>, <u>258</u>,
<u>259</u>, <u>261</u>, 262, <u>263</u>, <u>264</u>, <u>265</u>, <u>266</u>, <u>268</u>, <u>269</u>, <u>270</u>, <u>271</u>, <u>272</u>, <u>273</u>, 274, <u>275</u>, <u>276</u>,
<u>278</u>, <u>279</u>, <u>280</u>, <u>281</u>, <u>283</u>, 285, <u>286</u>, <u>288</u>, <u>291</u>, <u>295</u>, <u>296</u>, 298, <u>299</u>, <u>300</u>, <u>301</u>, 302,
<u>303</u>, 304, <u>305</u>, <u>307</u>, <u>308</u>, <u>310</u>, <u>311</u>, <u>312</u>, <u>314</u>, 316, <u>318</u>, <u>325</u>, <u>326</u>, <u>327</u>, 329, 330,
<u>331</u>, 332, <u>334</u>, 335, <u>336</u>, <u>340</u>, <u>341</u>, <u>342</u>, 343, <u>344</u>, 345, 346, <u>347</u>, <u>349</u>, 350, 351,
352, 353, <u>354</u>, 355, 357, <u>358</u>, 360, <u>361</u>, <u>362</u>, <u>363</u>, 364, <u>365</u>, <u>366</u>, <u>367</u>, 368, <u>369</u>,
370, <u>371</u>, <u>372</u>, <u>374</u>, <u>375</u>, <u>379</u>, <u>380</u>, <u>382</u>, 387, 388, <u>389</u>, <u>390</u>, <u>392</u>, <u>393</u>, <u>394</u>, <u>399</u>,
<u>400</u>, 404, <u>405</u>, <u>406</u>, <u>407</u>, 408, <u>409</u>, <u>410</u>, <u>411</u>, <u>412</u>, <u>413</u>, 414, 415, <u>416</u>, 417, <u>418</u>,
419, 420, <u>421</u>, <u>422</u>, 423, <u>424</u>, <u>425</u>, 426, <u>428</u>, 429, 431, 432, 433, 434, 435, <u>436</u>,
437, 438, <u>439</u>, <u>440</u>, <u>442</u>, 443, 444, <u>445</u>, <u>446</u>, <u>447</u>, 450, <u>451</u>, <u>453</u>, <u>454</u>, <u>455</u>, 456,
457, <u>458</u>, <u>459</u>, <u>461</u>, 462, <u>463</u>, <u>464</u>, <u>465</u>, <u>468</u>, <u>471</u>, 472, <u>473</u>, <u>474</u>, <u>476</u>, <u>477</u>, 480,
<u>481</u>, <u>482</u>, 484, 485, <u>486</u>, <u>487</u>, <u>489</u>, <u>490</u>, <u>491</u>, 492, 493, 494, <u>496</u>, <u>497</u>, 498, 499,
<u>500</u>, 501, <u>502</u>, <u>503</u>, <u>504</u>, <u>505</u>, <u>506</u>, 507, 508, 509, 510, 511, <u>512</u>, <u>513</u>, <u>514</u>, <u>515</u>,
516, <u>517</u>, <u>518</u>, <u>519</u>, <u>520</u>, <u>521</u>, <u>522</u>, <u>523</u>, 524, 525, 526, <u>527</u>, <u>528</u>, <u>529</u>, 530, 531,
<u>532</u>, <u>533</u>, 534, <u>535</u>, <u>536</u>, <u>539</u>, <u>541</u>, 542, 543, 544, <u>545</u>, <u>546</u>, <u>548</u>, 549, 552, <u>553</u>,
555, 556, 557, <u>558</u>, <u>559</u>, <u>560</u>, 561, 562, <u>563</u>, 564, <u>565</u>, <u>567</u>, <u>568</u>, <u>569</u>, 571, 574,
<u>575</u>, 576, <u>577</u>, <u>579</u>, 580, <u>582</u>, 583, <u>588</u>, 591, <u>592</u>, <u>593</u>, <u>594</u>, <u>595</u>, <u>596</u>

TABLE 6

| SEQ ID | PSORT | LP | TMDs | Top hit | HitLen | e | Identities | % Query | % Target |
|---|---|---|---|---|---|---|---|---|---|
| 2 | I | * | 1 | *Propionibacterium acnes* transporter-related polypeptide\|WO03/33515 | 221 | 3e−01 | 21/69 | 24 | 9 |
| 6 | I |   | 3 | *Propionibacterium acnes* immunogenic polypeptide\|WO03/33515 | 318 | 2e−10 | 49/171 | 27 | 15 |
| 7 | O | * | 0 | AmEPV late transcription factor-2 (AMV047)\|WO200212526 | 259 | 0.011 | 33/114 | 23 | 12 |
| 23 | I |   | 1 | Enterohaemorragic *E. coli* 0157:H7-specific protein SEQ ID NO: 1295\|JP2002355074 | 470 | 0.059 | 16/57 | 14 | 3 |
| 25 | I |   | 1 | Human XB51\|JP2003164298 | 273 | 3e−01 | 14/28 | 4 | 5 |
| 26 | I | * | 1 | Protein encoded by Prokaryotic essential gene\|WO200277183 | 324 | 9e−02 | 15/38 | 9 | 4 |
| 28 | P | * | 0 | Protein sequence SEQ ID 2281\|EP1258494 | 503 | 2e−02 | 21/81 | 9 | 4 |
| 29 | O |   | 0 | Novel human diagnostic protein\|WO200175067 | 1395 | 6e−17 | 42/120 | 25 | 3 |
| 30 | I |   | 1 | *Leishmania* extended antigen LmgSP10\|US2002169285 | 320 | 1e−02 | 36/157 | 9 | 11 |
| 31 | I |   | 1 | Protein encoded by Prokaryotic essential gene\|WO200277183 | 249 | 6e−02 | 27/95 | 11 | 10 |
| 32 | I |   | 1 | *Acinetobacter baumannii* protein\|US6562958 | 284 | 1e−06 | 53/215 | 19 | 18 |
| 36 | I |   | 2 | *C. glutamicum* homeostasis and adaptation protein SEQ ID 32\|WO03/40290 | 513 | 4e−02 | 15/33 | 10 | 2 |
| 49 | I |   | 1 | Prostate cancer marker protein\|WO03/09814 | 338 | 4e−01 | 16/52 | 30 | 4 |
| 57 | I |   | 1 | *Photorhabdus luminescens* protein sequence\|WO200294867 | 149 | 4e−02 | 15/41 | 36 | 10 |
| 59 | O | * | 0 | Protein encoded by Prokaryotic essential gene\|WO200277183 | 512 | 4e−02 | 13/40 | 20 | 2 |
| 67 | I | * | 1 | *Mycobacterium tuberculosis* nutrient starvation-inducible protein\|WO03/04520 | 429 | 4e−02 | 17/43 | 15 | 3 |
| 68 | I | * | 5 | *Acinetobacter baumannii* protein\|US6562958 | 273 | 6e−23 | 68/204 | 10 | 24 |
| 76 | I |   | 2 | *Plasmodium falciparum* chromosome 2 related protein SEQ ID NO: 152\|WO200025728 | 980 | 2e−05 | 42/172 | 13 | 4 |
| 77 | P |   | 0 | *Mycoplasma genitalium* outlier protein\|US2003039963 | 1139 | 9e−02 | 13/37 | 19 | 1 |
| 80 | O | * | 0 | Novel human diagnostic protein\|WO200175067 | 812 | 2e−01 | 33/111 | 7 | 4 |
| 81 | I |   | 2 | *Histophilus somni* holin fragment\|WO03/59392 | 74 | 3e−02 | 15/52 | 21 | 20 |
| 82 | P | * | 0 | Heamin-binding protein from ORF5 of plasmid pRAP501\|WO9321323 | 178 | 2e−20 | 61/163 | 35 | 34 |
| 83 | I | * | 3 | Hepatitis GB virus protein sequence SEQ ID NO: 53\|US6051374 | 177 | 0.033 | 23/75 | 16 | 12 |
| 84 | P |   | 0 | Novel human secreted and transmembrane protein\|WO03/72035 | 591 | 0.004 | 26/80 | 18 | 4 |

TABLE 6-continued

| SEQ ID | PSORT | LP | TMDs | Top hit | HitLen | e | Identities | % Query | % Target |
|---|---|---|---|---|---|---|---|---|---|
| 85 | I | | 1 | *Mycobacterium* species protein sequence 46C|WO9909186 | 119 | 5e−02 | 28/84 | 15 | 23 |
| 87 | I | | 8 | Enzyme EPS11 involved in exopolysaccharide biosynthesis|WO9962316 | 504 | 3e−23 | 86/320 | 25 | 17 |
| 88 | I | | 1 | Herbicidally active polypeptide SEQ ID NO 2856|WO200210210 | 638 | 3e−01 | 35/139 | 18 | 5 |
| 89 | I | | 1 | Protein encoded by Prokaryotic essential gene|WO200277183 | 734 | 8e−02 | 12/24 | 7 | 1 |
| 93 | I | | 1 | Human GPCR protein SEQ ID NO: 1506|EP1270724 | 156 | 1e−01 | 20/66 | 15 | 12 |
| 94 | I | | 0 | *Plasmodium falciparum* chromosome 2 related protein|WO200025728 | 471 | 3e−02 | 16/74 | 16 | 3 |
| 96 | I | | 0 | Protein encoded by Prokaryotic essential gene|WO200277183 | 87 | 6e−09 | 28/47 | 51 | 32 |
| 112 | I | | 0 | *Staphylococcus aureus* protein|WO200294868 | 190 | 1e−01 | 12/36 | 15 | 6 |
| 114 | I | | 1 | Novel human secreted and transmembrane protein|US2003008352 | 1894 | 2e−04 | 23/61 | 23 | 1 |
| 124 | O | * | 0 | *E. coli* proliferation associated protein SEQ ID 365|WO200044906 | 176 | 6e−28 | 69/171 | 39 | 39 |
| 125 | O | * | 0 | *E. coli* proliferation associated protein SEQ ID 366|WO200044906 | 167 | 4e−25 | 68/151 | 40 | 40 |
| 138 | O | * | 0 | Protein encoded by Prokaryotic essential gene|WO200277183 | 312 | 4e−02 | 26/101 | 17 | 8 |
| 139 | I | | 1 | Human parathyroid cell calcium receptor 5.2 (HuPCaR 5.2)|US5688938 | 1088 | 7e−02 | 32/118 | 10 | 2 |
| 142 | I | * | 2 | Protein encoded by Prokaryotic essential gene|WO200277183 | 285 | 2e−02 | 32/158 | 12 | 11 |
| 143 | I | | 2 | Human Down syndrome-cell adhesion molecule DS-CAM2|WO9817795 | 1571 | 3e−01 | 27/104 | 11 | 1 |
| 145 | I | | 2 | Protein encoded by Prokaryotic essential gene|WO200277183 | 679 | 3e−01 | 17/55 | 23 | 2 |
| 147 | P | * | 0 | Human NS protein sequence SEQ ID NO: 159|WO200206315 | 354 | 1e−01 | 14/41 | 23 | 3 |
| 149 | I | | 1 | Enterohaemorragic *E. coli* O157:H7-specific protein|JP2002355074 | 55 | 0.003 | 18/29 | 41 | 32 |
| 150 | I | | 0 | Human p53 modifying protein, SEQ ID 214|WO200299122 | 409 | 4e−02 | 13/42 | 11 | 3 |
| 153 | I | | 1 | Enterohaemorragic *E. coli* O157:H7-specific protein: 949|JP2002355074 | 50 | 1e−19 | 46/50 | 92 | 92 |
| 155 | I | | 0 | *Plasmodium falciparum* chromosome 2 related protein|WO200025728 | 1700 | 5e−02 | 14/34 | 11 | 0 |
| 159 | P | * | 0 | Novel human diagnostic protein|WO200175067 | 260 | 4e−02 | 25/56 | 46 | 9 |
| 160 | I | * | 1 | Mouse PG1 protein sequence|WO9932644 | 354 | 4e−02 | 14/37 | 14 | 3 |
| 161 | I | | 2 | *Alloiococcus otitis* antigenic protein SEQ ID NO: 1640|WO03/48304 | 225 | 9e−02 | 16/46 | 15 | 7 |
| 165 | I | | 0 | *A. niger* metalloprotease polypeptide|WO200268623 | 791 | 3e−01 | 29/110 | 24 | 3 |
| 167 | I | | 0 | *Pinus radiata* cell signalling involved protein SEQ ID: 128|WO200042171 | 120 | 2e−01 | 19/54 | 35 | 15 |
| 170 | I | | 1 | Enterohaemorragic *E. coli* O157:H7-specific protein: 881|JP2002355074 | 53 | 2e−13 | 38/42 | 15 | 71 |
| 171 | I | | 0 | Enterohaemorragic *E. coli* O157:H7-specific protein: 615|JP2002355074 | 50 | 1e−21 | 48/50 | 96 | 96 |
| 176 | P | * | 0 | Protein encoded by Prokaryotic essential gene|WO200277183 | 239 | 3e−11 | 33/81 | 26 | 13 |
| 178 | I | | 0 | Human colon cancer antigen protein SEQ ID NO: 7716|WO200122920 | 134 | 4e−02 | 11/20 | 8 | 8 |
| 179 | I | | 3 | Human GPCR protein SEQ ID NO: 1630|EP1270724 | 523 | 0.014 | 23/115 | 16 | 4 |
| 181 | I | | 0 | Bovine herpesvirus 1 US3 protein sequence SEQ ID NO: 9|WO03/12049 | 468 | 2e−02 | 17/56 | 7 | 3 |
| 183 | I | | 1 | Novel human diagnostic protein|WO200175067 | 260 | 0.007 | 32/75 | 38 | 12 |
| 184 | I | * | 1 | *N. gonorrhoeae* amino acid sequence SEQ ID 7826|WO200279243 | 508 | 4e−02 | 28/90 | 28 | 5 |
| 188 | I | | 1 | *Lactococcus lactis* protein ycdH|FR2807446 | 486 | 3e−01 | 18/61 | 24 | 3 |
| 194 | I | | 1 | MeCP2-Tat dMT fusion protein|WO200285948 | 561 | 0.029 | 11/22 | 15 | 2 |
| 195 | I | | 1 | Protein encoded by Prokaryotic essential gene|WO200277183 | 80 | 1e−17 | 44/80 | 47 | 55 |
| 197 | I | | 1 | *S. cinnamonensis* CapK homologue|WO200168867 | 427 | 3e−18 | 91/350 | 21 | 21 |
| 198 | I | | 4 | Protein encoded by Prokaryotic essential gene|WO200277183 | 219 | 4e−11 | 49/178 | 24 | 22 |
| 199 | I | | 8 | Protein of drug metabolising enzyme-2804794CD1|WO200266654 | 445 | 2e−28 | 78/231 | 20 | 17 |
| 200 | I | | 4 | Synechocystis delta-6-desaturase polypeptide|US2002108147 | 359 | 2e−19 | 84/347 | 23 | 23 |
| 202 | I | | 0 | Protein encoded by Prokaryotic essential gene|WO200277183 | 615 | 4e−01 | 14/41 | 29 | 2 |
| 207 | I | | 1 | Protein encoded by Prokaryotic essential gene|WO200277183 | 230 | 1e−14 | 41/54 | 65 | 17 |
| 208 | I | | 1 | *Acinetobacter baumannii* protein|US6562958 | 358 | 2e−11 | 29/86 | 28 | 8 |
| 209 | I | | 1 | *Acinetobacter baumannii* protein|US6562958 | 515 | 1e−06 | 29/124 | 21 | 5 |
| 210 | I | * | 2 | Bacterial polypeptide|US6605709 | 320 | 3e−27 | 55/165 | 45 | 17 |
| 211 | I | | 1 | *S cerevisiae* apoptosis associated protein YOR010C|WO200102550 | 730 | 8e−02 | 15/53 | 20 | 2 |
| 212 | I | | 1 | Protein encoded by Prokaryotic essential gene|WO200277183 | 240 | 4e−19 | 50/56 | 64 | 20 |
| 225 | P | * | 0 | *Listeria monocytogenes* protein|WO200177335 | 100 | 2e−26 | 57/97 | 55 | 56 |
| 228 | P | * | 0 | *Drosophila melanogaster* polypeptide SEQ ID NO 19890|WO200171042 | 460 | 5e−02 | 37/129 | 13 | 8 |
| 232 | I | | 1 | *Photorhabdus luminescens* protein sequence|WO200294867 | 393 | 5e−13 | 93/377 | 19 | 23 |
| 233 | O | * | 0 | *Photorhabdus luminescens* protein sequence|WO200294867 | 205 | 2e−11 | 50/183 | 27 | 24 |
| 235 | I | | 2 | *Photorhabdus luminescens* protein sequence|WO200294867 | 513 | 9e−02 | 22/58 | 7 | 4 |
| 236 | O | * | 0 | *Alloiococcus otitis* antigenic protein SEQ ID NO: 1664|WO03/48304 | 309 | 1e−02 | 15/30 | 7 | 4 |
| 237 | I | | 1 | 38 kd regression associated antigen|US5242823 | 403 | 6e−02 | 33/129 | 20 | 8 |
| 238 | I | | 1 | Enterohaemorragic *E. coli* O157:H7-specific protein: 1084|JP2002355074 | 131 | 1e−08 | 26/45 | 37 | 19 |
| 240 | I | | 0 | Human polypeptide SEQ ID NO 21835|WO200164835 | 81 | 2e−01 | 11/40 | 24 | 14 |
| 241 | I | | 1 | *Aspergillus fumigatus* essential gene protein|WO200286090 | 367 | 0.005 | 32/116 | 25 | 8 |
| 277 | I | | 1 | Bacterial polypeptide|US6605709 | 338 | 3e−01 | 20/64 | 11 | 5 |
| 279 | I | | 0 | *Escherichia coli* polypeptide SEQ ID NO 1320|WO200166572 | 367 | 0.017 | 45/217 | 12 | 12 |
| 280 | I | | 1 | Protein encoded by Prokaryotic essential gene|WO200277183 | 266 | 2e−02 | 28/105 | 7 | 10 |
| 281 | I | | 9 | *Streptococcus pneumoniae* polypeptide SEQ ID NO 329|WO200283855 | 477 | 7e−07 | 34/118 | 7 | 7 |
| 283 | I | | 11 | Protein encoded by Prokaryotic essential gene|WO200277183 | 431 | 6e−25 | 105/421 | 25 | 24 |
| 284 | P | * | 0 | Novel human diagnostic protein|WO200175067 | 285 | 7e−05 | 23/29 | 44 | 8 |
| 289 | I | | 1 | *H. pylori* selected interacting domain (SID) protein|WO200266501 | 268 | 2e−01 | 17/65 | 20 | 6 |
| 290 | I | | 0 | Novel human diagnostic protein|WO200175067 | 750 | 2e−01 | 16/23 | 32 | 2 |
| 306 | I | | 1 | *S. pneumoniae* antigenic protein SP092|US6573082 | 641 | 0.020 | 40/139 | 22 | 6 |
| 308 | O | * | 0 | *Listeria monocytogenes* protein|WO200177335 | 439 | 9e−02 | 16/53 | 17 | 3 |
| 309 | I | | 3 | Novel human diagnostic protein|WO200175067 | 285 | 0.001 | 17/23 | 14 | 5 |
| 314 | I | * | 1 | *N. gonorrhoeae* amino acid sequence SEQ ID 7826|WO200279243 | 508 | 8e−02 | 28/90 | 28 | 5 |
| 315 | I | * | 3 | Novel human diagnostic protein|WO200175067 | 261 | 2e−04 | 35/100 | 23 | 13 |
| 317 | I | | 0 | Bovine herpesvirus 1 US3 protein sequence SEQ ID NO: 9|WO03/12049 | 468 | 5e−02 | 18/56 | 6 | 3 |
| 322 | I | | 1 | *M. truncatula* squalene epoxidase|WO03/93425 | 526 | 1e−01 | 15/48 | 11 | 2 |
| 323 | I | | 2 | Human PECAM-1 protein SEQ ID NO: 73|WO200078808 | 738 | 4e−02 | 18/55 | 5 | 2 |
| 325 | I | | 1 | *E. coli* proliferation associated protein sequence: 300|WO200044906 | 138 | 2e−29 | 62/134 | 44 | 44 |
| 326 | P | * | 0 | Cucumber raffinose synthase|JP11123080 | 784 | 1e−01 | 21/68 | 8 | 2 |

TABLE 6-continued

| SEQ ID | PSORT | LP | TMDs | Top hit | HitLen | e | Identities | % Query | % Target |
|---|---|---|---|---|---|---|---|---|---|
| 327 | P | * | 0 | Predicted partial sequence of clone CXC-AMN20\|WO9634112 | 262 | 1e−05 | 70/286 | 20 | 26 |
| 348 | I |  | 2 | Human polypeptide SEQ ID NO 21123\|WO200164835 | 73 | 5e−02 | 15/47 | 30 | 20 |
| 352 | I |  | 1 | Protein encoded by Prokaryotic essential gene\|WO200277183 | 279 | 4e−29 | 72/225 | 30 | 25 |
| 354 | I |  | 2 | Novel human enzyme polypeptide\|WO200155301 | 190 | 3e−13 | 40/61 | 26 | 21 |
| 357 | I |  | 2 | Protein encoded by Prokaryotic essential gene\|WO200277183 | 898 | 7e−26 | 82/252 | 16 | 9 |
| 358 | I |  | 1 | Protein encoded by Prokaryotic essential gene\|WO200277183 | 206 | 5e−28 | 57/124 | 43 | 27 |
| 359 | P | * | 0 | *Drosophila melanogaster* polypeptide SEQ ID NO 5868\|WO200171042 | 1176 | 3e−01 | 19/75 | 23 | 1 |
| 368 | I |  | 1 | *S. pneumoniae* transport protein\|WO9826072 | 293 | 4e−02 | 23/82 | 11 | 7 |
| 374 | P | * | 0 | Novel human diagnostic protein\|WO200175067 | 701 | 0.012 | 24/82 | 27 | 3 |
| 375 | I |  | 4 | Bacterial polypeptide\|US6605709 | 184 | 0.001 | 36/168 | 23 | 19 |
| 377 | I |  | 0 | Rat Protein P26039, SEQ ID NO 11184\|WO03/16475 | 2541 | 4e−02 | 22/67 | 20 | 0 |
| 381 | I |  | 1 | *Photorhabdus luminescens* protein sequence\|WO200294867 | 323 | 2e−01 | 30/88 | 12 | 9 |
| 387 | I | * | 9 | *C glutamicum* protein fragment SEQ ID NO: 4758\|EP1108790 | 405 | 5e−08 | 79/354 | 19 | 19 |
| 389 | P | * | 0 | Enterohaemorragic *E. coli* O157:H7-specific protein: 1016\|JP2002355074 | 108 | 3e−20 | 42/80 | 11 | 38 |
| 390 | O | * | 0 | Protein encoded by Prokaryotic essential gene\|WO200277183 | 230 | 6e−15 | 58/207 | 23 | 25 |
| 391 | I |  | 1 | Cephalosporin C acetylesterase\|JP04144688 | 231 | 2e−18 | 67/218 | 24 | 29 |
| 395 | O | * | 0 | Protein encoded by Prokaryotic essential gene\|WO200277183 | 312 | 4e−02 | 26/101 | 17 | 8 |
| 396 | I |  | 1 | *C glutamicum* protein fragment SEQ ID NO: 5209\|EP1108790 | 261 | 8e−02 | 15/30 | 6 | 5 |
| 397 | I |  | 0 | *Acinetobacter* sp. recombinase\|US2003087403 | 324 | 9e−03 | 20/50 | 39 | 6 |
| 401 | O | * | 0 | *Streptococcus sobrinus* glucosyltransferase-U\|WO03/75845 | 1554 | 9e−02 | 30/139 | 9 | 1 |
| 402 | I |  | 1 | *Lactococcus lactis* protein yjeD\|FR2807446 | 543 | 3e−15 | 77/331 | 22 | 14 |
| 403 | I |  | 1 | Fukuyama-type congenital muscular dystrophy-causing prtn\|JP11313682 | 461 | 9e−06 | 42/167 | 10 | 9 |
| 404 | I |  | 6 | Protein encoded by Prokaryotic essential gene\|WO200277183 | 264 | 1e−16 | 60/237 | 23 | 22 |
| 407 | I | * | 5 | *Photorhabdus luminescens* protein sequence\|WO200294867 | 367 | 2e−23 | 86/345 | 24 | 23 |
| 412 | I |  | 4 | *Photorhabdus luminescens* protein sequence\|WO200294867 | 139 | 3e−24 | 50/121 | 31 | 35 |
| 421 | I |  | 1 | *Lactococcus lactis* protein yqbF\|FR2807446 | 320 | 0.093 | 27/78 | 22 | 8 |
| 427 | I |  | 1 | *Streptococcus* polypeptide SEQ ID NO 7746\|WO200234771 | 139 | 2e−02 | 30/110 | 12 | 21 |
| 441 | O | * | 0 | Human ORFX protein sequence SEQ ID NO: 18748\|WO200192523 | 130 | 8e−02 | 14/42 | 10 | 10 |
| 445 | I |  | 1 | Novel human diagnostic protein\|WO200175067 | 717 | 3e−04 | 24/33 | 14 | 3 |
| 446 | I |  | 4 | *Haemophilus influenzae* essential gene\|WO200218601 | 165 | 7e−11 | 31/126 | 20 | 18 |
| 449 | I |  | 1 | Human polypeptide SEQ ID NO 21123\|WO200164835 | 73 | 6e−02 | 21/65 | 15 | 28 |
| 461 | I |  | 1 | Bacterial polypeptide\|US6605709 | 376 | 1e−20 | 87/358 | 23 | 23 |
| 466 | I |  | 3 | *Arabidopsis thaliana* protein fragment SEQ ID NO: 49986\|EP1033405 | 382 | 2e−02 | 18/54 | 9 | 4 |
| 467 | I |  | 1 | *Listeria monocytogenes* protein\|WO200177335 | 400 | 6e−19 | 90/309 | 20 | 22 |
| 468 | I |  | 1 | *H. influenzae* Orf25 polypeptide SEQ ID NO: 49\|WO03/55905 | 664 | 2e−08 | 62/287 | 10 | 9 |
| 473 | I |  | 1 | *Listeria monocytogenes* protein\|WO200177335 | 95 | 4e−17 | 44/48 | 53 | 46 |
| 475 | I |  | 1 | Human Protein P57723, SEQ ID NO 11321\|WO03/16475 | 403 | 9e−02 | 18/36 | 18 | 4 |
| 479 | I |  | 1 | Novel human secreted/transmembrane prtn PRO1110\|US2003215911 | 322 | 3e−01 | 13/42 | 20 | 4 |
| 487 | I |  | 2 | Human polypeptide SEQ ID NO 16040\|WO200164835 | 94 | 2e−02 | 21/89 | 7 | 22 |
| 488 | I |  | 0 | Human polypeptide SEQ ID NO 18650\|WO200164835 | 115 | 4e−01 | 15/32 | 26 | 13 |
| 490 | I |  | 1 | Protein encoded by Prokaryotic essential gene\|WO200277183 | 277 | 9e−02 | 20/78 | 4 | 7 |
| 491 | I |  | 1 | Protein encoded by Prokaryotic essential gene\|WO200277183 | 622 | 3e−01 | 14/39 | 2 | 2 |
| 493 | I |  | 1 | Bacterial polypeptide\|US6605709 | 168 | 3e−06 | 36/118 | 21 | 21 |
| 541 | I |  | 4 | *Acinetobacter baumannii* protein\|US6562958 | 146 | 2e−14 | 43/130 | 32 | 29 |
| 547 | I |  | 1 | Protein encoded by Prokaryotic essential gene\|WO200277183 | 1765 | 8e−02 | 22/64 | 14 | 1 |
| 554 | I |  | 1 | Human GPCR protein SEQ ID NO: 1864\|EP1270724 | 294 | 0.058 | 30/72 | 34 | 10 |
| 561 | I |  | 1 | *S. pneumoniae* transport protein\|WO9826072 | 293 | 4e−02 | 23/82 | 11 | 7 |
| 566 | O | * | 0 | Enterohaemorragic *E. coli* O157:H7-specific protein: 202\|JP2002355074 | 48 | 4e−18 | 39/48 | 26 | 81 |
| 573 | I |  | 1 | *Propionibacterium acnes* predicted ORF-encoded polypeptide\|WO03/33515 | 215 | 4e−10 | 52/191 | 23 | 24 |
| 574 | O | * | 0 | *Photorhabdus luminescens* protein sequence\|WO200294867 | 157 | 2e−10 | 46/134 | 22 | 29 |
| 576 | I |  | 0 | *Alloiococcus otitis* antigenic protein SEQ ID NO: 5934\|WO03/48304 | 262 | 9e−26 | 90/273 | 34 | 34 |
| 578 | I |  | 1 | *Streptococcus pneumoniae* polypeptide SEQ ID NO 382\|WO200283855 | 456 | 3e−02 | 17/35 | 12 | 3 |
| 585 | O | * | 0 | *Bifidobacterium longum* NCC2705 ORF amino acid sequence SEQ ID NO: 298\|EP1227152 | 180 | 2e−01 | 14/42 | 12 | 7 |
| 586 | O | * | 0 | Human secreted polypeptide\|US2003100051 | 266 | 1e−01 | 11/33 | 11 | 4 |
| 588 | I |  | 1 | Novel human diagnostic protein\|WO200175067 | 1387 | 1e−01 | 22/83 | 16 | 1 |
| 595 | I |  | 1 | Protein encoded by Prokaryotic essential gene\|WO200277183 | 345 | 3e−01 | 15/32 | 27 | 4 |

Columns:
PSORT: predicted location by the PSORT algorithm. I = inner membrane; O = outer membrane; P = periplasm
LP: a star indicates a lipoprotein
TMDs: number of transmembrane domains
Top hit: closest match in patent database
HitLen: length of the closest match
e: 'expected' value in BLAST analysis
Identities: number of identical residues over length of alignment, and length of the alignment
% Query/% Target: % sequence identity from perspective of ExPEC or database sequence

TABLE 7

| Protein | gi# | SEQ ID | Annotation | Psort | TMD |
|---|---|---|---|---|---|
| upec-4519 | 26110866 | 489 | Putative conserved protein | I | 1 |
| upec-3573 | 26109898 | 597 | Antigen 43 precursor | I | 1 |
| upec-1196 | 26107513 | 120 | F1C major fimbrial subunit | O | 0 |
| upec-2283 | 26108604 | 598 | Outer membrane porin p | C | 0 |
| upec-2814 | 26109137 | 305 | Long-chain fatty acid | O | 0 |
| upec-0179 | 26106493 | 22 | Ferrichrome-iron receptor precursor | O | 0 |
| upec-1875 | 26108194 | 221 | Type-1 fimbrial protein | I | 1 |
| upec-1873 | 26108192 | 219 | Outer membrane usher | I | 1 |
| upec-3606 | 26109931 | 400 | KpsD protein | P | 0 |
| upec-5079 | 26111428 | 565 | PapA protein | O | 0 |
| upec-3510 | 26109835 | 371 | PapA protein | O | 0 |
| upec-3541 | 26109866 | 599 | IutA protein | C | 0 |
| upec-5065 | 26111414 | 555 | Putative iron-regulated protein | I | 1 |

Columns:
PSORT: predicted location by the PSORT algorithm. I = inner membrane; O = outer membrane; P = periplasm; C = cytoplasm
TMD: number of transmembrane domains
% ID: percentage identical residues over length of alignment

REFERENCES

The Contents of which are Hereby Incorporated by Reference

[1] Russo & Johnson (2000) *J Infect Dis* 181:1753-1754.
[2] Uehling et al. (1997) *J Urol* 157:2049-2052.
[3] Tammen (1990) *Br J Urol* 65:6-9.
[4] Langermann et al. (1997) *Science* 276:607-611.
[5] WO03/074553.
[6] WO01/66572.
[7] Janke et al. (2001) *FEMS Microbiol Lett* 199:61-66.
[8] WO2004/005535.
[9] Dobrindt et al. (2002) *Infect Immun* 70:6365-6372.
[10] US2003/0165870.
[11] Welch et al. (2002) *Proc Natl Acad Sci USA* 99:17020-17024.
[12] American Type Culture Collection: ATCC 700928.
[13] *European Journal of Biochemistry* 2003; 1 Supplement 1 July: abstract P1.3-11.
[14] Geysen et al. (1984) *PNAS USA* 81:3998-4002.
[15] Carter (1994) *Methods Mol Biol* 36:207-223.
[16] Jameson, B A et al. 1988, *CABIOS* 4(1):181-186.
[17] Raddrizzani & Hammer (2000) *Brief Bioinform* 1(2):179-189.
[18] De Lalla et al. (1999) *J. Immunol.* 163:1725-1729.
[19] Brusic et al. (1998) *Bioinformatics* 14(2):121-130
[20] Meister et al. (1995) *Vaccine* 13(6):581-591.
[21] Roberts et al. (1996) *AIDS Res Hum Retroviruses* 12(7):593-610.
[22] Maksyutov & Zagrebelnaya (1993) *Comput Appl Biosci* 9(3):291-297.
[23] Feller & de la Cruz (1991) *Nature* 349(6311):720-721.
[24] Hopp (1993) *Peptide Research* 6:183-190.
[25] Welling et al. (1985) *FEBS Lett.* 188:215-218.
[26] Davenport et al. (1995) *Immunogenetics* 42:392-397.
[27] Bodanszky (1993) *Principles of peptide Synthesis* (ISBN: 0387564314).
[28] Fields et al. (1997) *Meth Enzymol* 289: *Solid-Phase Peptide Synthesis*. ISBN: 0121821900.
[29] Chan & White (2000) *Fmoc Solid Phase Peptide Synthesis*. ISBN: 0199637245.
[30] Kullmann (1987) *Enzymatic Peptide Synthesis*. ISBN: 0849368413.
[31] Ibba (1996) *Biotechnol Genet Eng Rev* 13:197-216.
[32] Breedveld (2000) *Lancet* 355(9205):735-740.
[33] Gorman & Clark (1990) *Semin. Immunol.* 2:457-466.
[34] Sambrook et al. (2001) *Molecular Cloning. A Laboratory Manual,* 3rd edition (Cold Spring Harbor Laboratory Press).
[35] Ausubel et al. (eds) (2002) *Short protocols in molecular biology,* 5th edition (Current Protocols).
[36] U.S. Pat. No. 5,707,829
[37] *Current Protocols in Molecular Biology* (F. M. Ausubel et al. eds., 1987) Supplement 30.
[38] EP-B-0509612.
[39] EP-B-0505012.
[40] Johnson & Stell (2001) *J Clin Microbiol* 39:3712-3717.
[41] Tang et al. (1997) *Clin. Chem.* 43:2021-2038.
[42] PCT/IB2005/003494.
[43] Bernadac et al. (1998) *J Bacteriol* 180(18):4872-4878.
[44] EP-1441036.
[45] Sorensen & Mortensen (2005) *Journal of Biotechnology* 115:113-128.
[46] Meynial-Salles et al. (2005) *Applied and Environmental Microbiology* 71:2140-2144.
[47] US2004/0209370.
[48] WO00/68253.
[49] WO97/04110.
[50] Alper et al. (2005) *Proc. Natl. Acad. Sci. USA* 102:12678-12683.
[51] WO 01/09350.
[52] European patent 0624376.
[53] *Vaccine Design* . . . (1995) eds. Powell & Newman. ISBN: 030644867X. Plenum.
[54] WO00/23105.
[55] WO90/14837.
[56] Podda (2001) *Vaccine* 19:2673-2680.
[57] Frey et al. (2003) *Vaccine* 21:4234-4237.
[58] *Vaccine Adjuvants: Preparation Methods and Research Protocols* (Volume 42 of *Methods in Molecular Medicine* series). ISBN: 1-59259-083-7. Ed. O'Hagan.
[59] U.S. Pat. No. 6,299,884.
[60] U.S. Pat. No. 6,451,325.
[61] Allison & Byars (1992) *Res Immunol* 143:519-525.
[62] Hariharan et al. (1995) *Cancer Res* 55:3486-3489.
[63] U.S. Pat. No. 5,057,540.
[64] WO96/33739.
[65] EP-A-0109942.
[66] WO96/11711.
[67] WO00/07621.
[68] Barr et al. (1998) *Advanced Drug Delivery Reviews* 32:247-271.
[69] Sjolanderet et al. (1998) *Advanced Drug Delivery Reviews* 32:321-338.
[70] Niikura et al. (2002) *Virology* 293:273-280.
[71] Lenz et al. (2001) *J Immunol* 166:5346-5355.
[72] Pinto et al. (2003) *J Infect Dis* 188:327-338.
[73] Gerber et al. (2001) *Virol* 75:4752-4760.
[74] WO03/024480
[75] WO03/024481
[76] Gluck et al. (2002) *Vaccine* 20:B10-B16.
[77] EP-A-0689454.
[78] Johnson et al. (1999) *Bioorg Med Chem Lett* 9:2273-2278.
[79] Evans et al. (2003) *Expert Rev Vaccines* 2:219-229.
[80] Meraldi et al. (2003) *Vaccine* 21:2485-2491.
[81] Pajak et al. (2003) *Vaccine* 21:836-842.
[82] Kandimalla et al. (2003) *Nucleic Acids Research* 31:2393-2400.

[83] WO02/26757.
[84] WO99/62923.
[85] Krieg (2003) *Nature Medicine* 9:831-835.
[86] McCluskie et al. (2002) *FEMS Immunology and Medical Microbiology* 32:179-185.
[87] WO98/40100.
[88] U.S. Pat. No. 6,207,646.
[89] U.S. Pat. No. 6,239,116.
[90] U.S. Pat. No. 6,429,199.
[91] Kandimalla et al. (2003) *Biochemical Society Transactions* 31 (part 3):654-658.
[92] Blackwell et al. (2003) *J Immunol* 170:4061-4068.
[93] Krieg (2002) *Trends Immunol* 23:64-65.
[94] WO01/95935.
[95] Kandimalla et al. (2003) *BBRC* 306:948-953.
[96] Bhagat et al. (2003) *BBRC* 300:853-861.
[97] WO03/035836.
[98] WO95/17211.
[99] WO98/42375.
[100] Beignon et al. (2002) *Infect Immun* 70:3012-3019.
[101] Pizza et al. (2001) *Vaccine* 19:2534-2541.
[102] Pizza et al. (2000) *Int J Med Microbiol* 290:455-461.
[103] Scharton-Kersten et al. (2000) *Infect Immun* 68:5306-5313.
[104] Ryan et al. (1999) *Infect Immun* 67:6270-6280.
[105] Partidos et al. (1999) *Immunol Lett* 67:209-216.
[106] Peppoloni et al. (2003) *Expert Rev Vaccines* 2:285-293.
[107] Pine et al. (2002) *J Control Release* 85:263-270.
[108] Domenighini et al. (1995) *Mol Microbiol* 15:1165-1167.
[109] WO03/011223.
[110] WO99/40936.
[111] WO99/44636.
[112] Lillard J W et al., (2003) *Blood* 101(3):807-814. Epub 2002 Sep. 12.
[113] Singh et al] (2001) *J Cont Release* 70:267-276.
[114] WO99/27960.
[115] U.S. Pat. No. 6,090,406
[116] U.S. Pat. No. 5,916,588
[117] EP-A-0626169.
[118] WO99/52549.
[119] WO01/21207.
[120] WO01/21152.
[121] Andrianov et al. (1998) *Biomaterials* 19:109-115.
[122] Payne et al. (1998) *Adv Drug Delivery Review* 31:185-196.
[123] U.S. Pat. No. 4,680,338.
[124] U.S. Pat. No. 4,988,815.
[125] WO92/15582.
[126] Stanley (2002) *Clin Exp Dermatol* 27:571-577.
[127] Wu et al. (2004) *Antiviral Res.* 64(2):79-83.
[128] Vasilakos et al. (2000) *Cell Immunol.* 204(1):64-74.
[129] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293.
[130] Jones (2003) *Curr Opin Investig Drugs* 4:214-218.
[131] WO04/60308
[132] WO04/64759.
[133] U.S. Pat. No. 6,924,271.
[134] US2005/0070556.
[135] U.S. Pat. No. 5,658,731.
[136] Wong et al. (2003) *J Clin Pharmacol* 43(7):735-42.
[137] US2005/0215517.
[138] WO02/072012.
[139] Signorelli & Hadden (2003) *Int Immunopharmacol* 3(8):1177-1186.
[140] WO2004/064715.
[141] Cooper (1995) *Pharm Biotechnol* 6:559-580.
[142] PCT/US2005/022769.
[143] WO2004/87153.
[144] U.S. Pat. No. 6,605,617.
[145] WO02/18383.
[146] WO2004/018455.
[147] WO03/082272.
[148] U.S. Pat. No. 5,011,828.
[149] U.S. Pat. No. 6,586,409.
[150] WO99/11241.
[151] WO94/00153.
[152] WO98/57659.
[153] European patent applications 0835318, 0735898 and 0761231.
[154] WO03/009869.
[155] Glezen & Alpers (1999) *Clin. Infect. Dis.* 28:219-224.
[156] Johnson et al. (2001) *Infect Immun* 69:1306-1314.
[157] Johnson et al. (2001) *J Infect Dis* 183:897-906 (see also 183:1546).
[158] Johnson, Hopkins (1998) *Infection and Immunity* 66:6063-6064.
[159] Bahrani-Mougeot et al.; Molecular Microbiology (2002) 45(4), 1079-1093
[160] Johnson et al., Infection and Immunity, (1998) 3059-3065
[161] Almeida & Alpar (1996) *J. Drug Targeting* 3:455-467.
[162] Agarwal & Mishra (1999) *Indian J Exp Biol* 37:6-16.
[163] Costantino et al. (1992) *Vaccine* 10:691-698.
[164] Costantino et al. (1999) *Vaccine* 17:1251-1263.
[165] International patent application WO03/007985.
[166] WO 99/24578.
[167] WO 99/36544.
[168] WO 99/57280.
[169] WO 00/66791.
[170] WO 01/64922.
[171] WO 01/64920.
[172] WO 03/020756.
[173] WO 2004/032958.
[174] WO 2004/048404.
[175] Watson (2000) *Pediatr Infect Dis J* 19:331-332.
[176] Rubin (2000) *Pediatr Clin North Am* 47:269-285.
[177] Jedrzejas (2001) *Microbiol Mol Biol Rev* 65:187-207.
[178] Bell (2000) *Pediatr Infect Dis J* 19:1187-1188.
[179] Iwarson (1995) *APMIS* 103:321-326.
[180] Gerlich et al. (1990) *Vaccine* 8 Suppl:S63-68 & 79-80.
[181] Hsu et al. (1999) *Clin Liver Dis* 3:901-915.
[182] Stratov et al. (2004) *Curr Drug Tgts* 5(1):71-88.
[183] Plotkin et al. (eds) (2003) *Vaccines*, 4th edition (W.B. Saunders Company)
[184] Del Guidice et al. (1998) *Molecular Aspects of Medicine* 19:1-70.
[185] Gustafsson et al. (1996) *N. Engl. J. Med.* 334:349-355.
[186] Rappuoli et al. (1991) *TIBTECH* 9:232-238.
[187] Sutter et al. (2000) *Pediatr Clin North Am* 47:287-308.
[188] Zimmerman & Spann (1999) *Am Fam Physician* 59:113-118, 125-126.
[189] McMichael (2000) *Vaccine* 19 Suppl 1:S101-S107.
[190] Schuchat (1999) *Lancet* 353(9146):51-56.
[191] WO02/34771.
[192] WO 99/54457.
[193] WO 04/01846.
[194] WO 04/041157.
[195] WO 05/028618.

[196] WO 99/24578.
[197] WO 99/36544.
[198] WO 99/57280.
[199] WO 02/079243.
[200] WO 02/02606.
[201] Kalnan et al. (1999) *Nature Genetics* 21:385-389.
[202] Read et al. (2000) *Nucleic Acids Res* 28:1397-1406.
[203] Shirai et al. (2000) *J. Infect. Dis.* 181(Suppl 3):S524-S527.
[204] WO 99/27105.
[205] WO 00/27994.
[206] WO 00/37494.
[207] WO2005/084306.
[208] WO2005/002619.
[209] Ross et al. (2001) *Vaccine* 19:4135-4142.
[210] Dreesen (1997) *Vaccine* 15 Suppl:S2-S6.
[211] *MMWR Morb Mortal Wkly Rep* 1998 Jan. 16; 47(1):12, 19.
[212] Anderson (2000) *Vaccine* 19 Suppl 1:S59-S65.
[213] Kahn (2000) *Curr Opin Pediatr* 12:257-262.
[214] Crowe (1995) *Vaccine* 13:415-421.
[215] Modlin et al. (2001) *J Toxicol Clin Toxicol* 39:85-100.
[216] Demicheli et al. (1998) *Vaccine* 16:880-884.
[217] Stepanov et al. (1996) *J Biotechnol* 44:155-160.
[218] Dale (1999) *Infect Dis Clin North Am* 13:227-43, viii.
[219] Ferretti et al. (2001) *PNAS USA* 98: 4658-4663.
[220] Kuroda et al. (2001) *Lancet* 357(9264):1225-1240; see also pages 1218-1219.
[221] WO 00/09699.
[222] EP-A-0372501
[223] EP-A-0378881
[224] EP-A-0427347
[225] WO93/17712
[226] WO94/03208
[227] WO98/58668
[228] EP-A-0471177
[229] EP-A-0594610.
[230] WO00/56360
[231] WO91/01146
[232] WO00/61761
[233] WO01/72337
[234] Falugi et al. (2001) *Eur J Immunol* 31:3816-3824.
[235] Baraldo et al, (2004) *Infect Immun.* 72:4884-4887
[236] WO02/091998.
[237] Kuo et al. (1995) *Infect Immun.* 63:2706-2713.
[238] *Research Disclosure*, 453077 (January 2002)
[239] Donnelly et al. (1997) *Annu Rev Immunol* 15:617-648.
[240] Strugnell et al. (1997) *Immunol Cell Biol* 75(4):364-369.
[241] Cui (2005) *Adv Genet.* 54:257-89.
[242] Robinson & Torres (1997) *Seminars in Immunol* 9:271-283.
[243] Brunham et al. (2000) *J Infect Dis* 181 Suppl 3:S538-S543.
[244] Svanholm et al. (2000) *Scand J Immunol* 51(4):345-353.
[245] *DNA Vaccination—Genetic Vaccination* (1998) eds. Koprowski et al. (ISBN 3540633928).
[246] *Gene Vaccination: Theory and Practice* (1998) ed. Raz (ISBN 3540644288).
[247] Findeis et al., *Trends Biotechnol.* (1993) 11:202.
[248] Chiou et al. (1994) *Gene Therapeutics: Methods And Applications Of Direct Gene Transfer*. ed. Wolff.
[249] Wu et al., *J. Biol. Chem.* (1988) 263:621.
[250] Wu et al., *J. Biol. Chem.* (1994) 269:542.
[251] Zenke et al., *Proc. Natl. Acad. Sci.* (*USA*) (1990) 87:3655.
[252] Wu et al., *J. Biol. Chem.* (1991) 266:338.
[253] Jolly, *Cancer Gene Therapy* (1994) 1:51.
[254] Kimura, *Human Gene Therapy* (1994) 5:845.
[255] Connelly, *Human Gene Therapy* (1995) 1:185.
[256] Kaplitt, *Nature Genetics* (1994) 6:148.
[257] WO 90/07936.
[258] WO 94/03622.
[259] WO 93/25698.
[260] WO 93/25234.
[261] U.S. Pat. No. 5,219,740.
[262] WO 93/11230.
[263] WO 93/10218.
[264] U.S. Pat. No. 4,777,127.
[265] GB 2,200,651.
[266] EP-A-0 345 242.
[267] WO 91/02805.
[268] WO 94/12649.
[269] WO 93/03769.
[270] WO 93/19191.
[271] WO 94/28938.
[272] WO 95/11984.
[273] WO 95/00655.
[274] Curiel, *Hum. Gene Ther.* (1992) 3:147.
[275] Wu, *J. Biol. Chem.* (1989) 264:16985.
[276] U.S. Pat. No. 5,814,482.
[277] WO 95/07994.
[278] WO 96/17072.
[279] WO 95/30763.
[280] WO 97/42338.
[281] WO 90/11092.
[282] U.S. Pat. No. 5,580,859.
[283] U.S. Pat. No. 5,422,120.
[284] WO 95/13796.
[285] WO 94/23697.
[286] WO 91/14445.
[287] EP 0524968.
[288] Philip, *Mol. Cell. Biol.* (1994) 14:2411.
[289] Woffendin, *Proc. Natl. Acad. Sci.* (1994) 91:11581.
[290] U.S. Pat. No. 5,206,152.
[291] WO 92/11033.
[292] U.S. Pat. No. 5,149,655.
[293] WO 92/11033.
[294] Needleman & Wunsch (1970) *J. Mol. Biol.* 48, 443-453.
[295] Rice et al. (2000) *Trends Genet.* 16:276-277.
[296] Gennaro (2000) *Remington: The Science and Practice of Pharmacy*. 20th edition, ISBN: 0683306472.
[297] *Methods In Enzymology* (S. Colowick and N. Kaplan, eds., Academic Press, Inc.)
[298] *Handbook of Experimental Immunology*, Vols. I-IV (D. M. Weir and C. C. Blackwell, eds, 1986, Blackwell Scientific Publications)
[299] Sambrook et al. (2001) *Molecular Cloning: A Laboratory Manual*, 3rd edition (Cold Spring Harbor Laboratory Press).
[300] *Handbook of Surface and Colloidal Chemistry* (Birdi, K. S. ed., CRC Press, 1997)
[301] Ausubel et al. (eds) (2002) *Short protocols in molecular biology*, 5th edition (Current Protocols).
[302] *Molecular Biology Techniques: An Intensive Laboratory Course*, (Ream et al., eds., 1998, Academic Press)
[303] *PCR (Introduction to Biotechniques Series)*, 2nd ed. (Newton & Graham eds., 1997, Springer Verlag)
[304] http://www.ncbi.nlm.nih.gov/entrez/query.fcgi?CMD=search&DB=PubMed
[305] http://www.ncbi.nlm.nih.gov/entrez/viewer.fcgi?db=protein&val=26111674
[306] http://www.ncbi.nlm.nih.gov/entrez/viewer.fcgi?val=26111641&itemID=33&view=gbwithparts
[307] Blattner et al. (1997) *Science* 277:1453-1474.
[308] Murphy (1998) *J. Bacteriol* 180:2063-2071.

SEQUENCE LISTING (599 sequences)

SEQ ID NO: 1 - protein, 98 aa, Escherichia coli
MKKMQSIVLALSLVLVAPMAAQAAEITLVPSVKLQIGDRDNRGYYWDGGHWRDHGWWKQHYEWRGNRWHPYGPPPSPRHNKHNDHRGDHRPGPDKHHR

SEQ ID NO: 2 - protein, 87 aa, Escherichia coli
MIIVAITGMAVTGATTAGGNNIMNGEAIAGTHMDRRHRRAITSTMIIVAIIVRGLTNIIAKYQCRIAIRHYPALSGIDYKLNVVRSV

SEQ ID NO: 3 - protein, 253 aa, Escherichia coli
MSAKRRLLIACTLITAIYHFPAYSSLEYKGTFGSINAGYADWNSGFVNTHRGEVWKVTADFGVNFKEAEFYSFYESNVLNHAVAGRNHTVSAMTHVRLFDSDMTFFGKIYGQWDNSWGDDLDMFYGFGYLGWNGEWGFFKPYIGLHNQSGDYVSAKYGQTNGWNGYVVGWTAVLPFTLFDEKFVLSNWNEIELDRNDAYTEQQFGRNGLNGGLTIAWKFYPRWKASVTWRYFDNKLGYDGFGDQMIYMLGYDF

SEQ ID NO: 4 - protein, 509 aa, Escherichia coli
MVMISNFYQGIIMQKTLMASLIGLAVCTGNAFSPALAAEAKQPNLVIIMADDLGYGDLATYGHQIVKTPNIDRLAQEGVKFTDYYAPAPLSSPSRAGLLTGRMPFRTGIRSWIPSGKDVALGRNELTIANLLKAQGYDTAMMGKLHLNAGGDRTDQPQAQDMGFDYSLANTAGFVTDATLDNAKERPRYGMVYPTGWLRNGQPTPRADKMSGEYVSSEVVNWLDNKKDSKPFFLYVAFTEVHSPLASPKKYLDMYSQYMSAYQKQHPDLFYGDWADKPWRGVGEYYANISYLDAQVGKVLDKIKAMGEEDNTIVIFTSDNGPVTREARKVYELNLAGETDGLRGRKDNLWEGGIRVPAIIKYGKHLPQGMVSDTPVYGLDWMPTLAKMMNFKLPTDRTFDGESLVPVLEQKALKREKPLIFGIDMPFQDDPTDEWAIRDGDWKMIIDRNNKPKYLYNLKSDRYETLNLIGKKPDIEKQMYGKFLKYKTDIDNDSLMKARGDKPEAVTWG

SEQ ID NO: 5 - protein, 42 aa, Escherichia coli
MPVVVSFVKKPALAGFFISICRPKFGLQSTNVYFEAGVNSAE

SEQ ID NO: 6 - protein, 121 aa, Escherichia coli
MTYGEAYLEGWKNIFNYEGVSNRFEFWSFMIGSGVICLLPLLCWWLAVTINNDYGVFIFFALPVSFILTLIFAVPAIALAVRRMHDIGYSGWWVTIAVLIPVTGVILLILCCLPSKSQDQA

SEQ ID NO: 7 - protein, 140 aa, Escherichia coli
MSKYIYILLSFLVLFFIFFYAYISLMSKEHHYTQHELSPFFLYTPESLRNLPNISNVAEYSYYYNVDDMQTRVIVTWRNIDNIFLQKAKLIDFLKRMGPSLQNDCIWFFHDKSDYANNFQRYCVIEHRDSLQVEYFETIE

SEQ ID NO: 8 - protein, 40 aa, Escherichia coli
MDYYAVVNDSLLGSGFCFYQNLYLYVFLILLILLFLILYA

SEQ ID NO: 9 - protein, 47 aa, Escherichia coli
MISVFFTCFLRATTLLFYVINIIALARRDDVSYIVLLSTLFRVFKQG

SEQ ID NO: 10 - protein, 40 aa, Escherichia coli
MRFQYFTCFLRAPTLLFYVINIIALARRDDVPYSFIIYFV

SEQ ID NO: 11 - protein, 296 aa, Escherichia coli
MMPLLDKLREQYGVGPLCSELHIAPSTYYHCQQQRHHPDKRSARAQRDDWLKKEIQRVYDENHKVYGVRKVWRQLLREGIRVARCTVARLMAVMGLAGVLRGKKVRTTISRKAVAAGDRVNRQFVAERPDQLWVADFTYVSTWRGFVYVAFIIDVFAGYIVGWRVSSSMETTFVLDALEQALWARRPSGTVHHSDKGSQYVSLAYTQRLKEAGLLASTGSTGDSYDNAMAESINGLYKAEVIHRKSWKNRAEVELATLTWVDWYNNRRLLERLGHTPPAEAEKAYYASIGNDDLAA

SEQ ID NO: 12 - protein, 593 aa, Escherichia coli
MKMTLPFKPHVLALICSAGLCAASAGLYIKSRTVEAPVEAQSTQQTAPDISAVTLPATVSVPPVTPAVVKSAFSTAQIDQWVAPVALYPDALLSQVLMASTYPTNVAQAVQWSHDNPLKQGDAAIQAVSDQPWDASVKSLVAFPQLMALMGENPQWVQNLGDAFLAQPQDVMDSVQRLRQLAQQTGSLKSSTEQKIITTTKKVVPVNQPANAPATQSNTVSTSSPVVAEPAPTVIAIEPANPDVVYIPNYNPNVVYGSWANTAYPPVYLPPPAGEPFVDSFVRGFGYSMGVATTYALFSSIDWDDDDHDHHHHDDHDHHHHDDDDYHHHDGGHRDGNDWQHNGDNINIDVNNFNRITGEHLTDKNMAWRHNPNYRDGMPYHDQDMAKRFHQTDVKGGMSATPLPAPTRDSQRQAAASQFQQRTHAAPVITRDTQRQAAAQRFNEAEHYGSYDDFRDFSRRQPLTQQQKDAARQRYQSASPEQRQAAREKMQTNPQNQQRREAARQRIQSASPEQRQAVREKMQTNPQNQQQRDAARQRIQSASPEQRQVFREKVQESRPQRLNDSNHTARLNNEQRSAVRERLSERGARRLER

SEQ ID NO: 13 - protein, 429 aa, Escherichia coli
MQHDNGVKMKTFFRYFLFLALCSCCYTASAGTDDNVSYLVGNDYGVGPGDQKWRETGPSADITVKFRYSTSTNNLVFYKPTQLGPTGVSLYWSQLNSASGGGYLYCNRSNTASGEPMAIENQMVDSGKRYGGHKLFETSVPGLYYTLKISNIWSSYTTTNISSSGMYIGDSPTQYFRWIPESEATLYWSCNNANSSNKYWAVGGVWQSLTVEFYTDTNFDPTKTNKVTLSKPGGYLYSFKGYGLGGGINGHSYFLKIDFDLDNMTLSNPTCFTAALTGPSVSGSTVKMGDYSPAQIKNGATAVPFDITLQNCIRVRNIETKLKSNKVGSVSKELLANTLTGNDAAKGVGVLIEGLKNTKSAQMVLKPNDSTSVYKDYETEDDTTGGIYPDKGNGTSQPLHFQATLKQDGNIAIEPGDFKATSTFQVTYP

SEQ ID NO: 14 - protein, 198 aa, Escherichia coli
MRPTQRNLMKKSILLLSLLFSATSPVVAGQDVDIVANIKNNTCQSGISNNGNIDLGVVGVGDFTGNISAENYHPGGKEFTITVQDCTLQGTGNVLNQLHINFRALSGVMATGSSQIFANEDNAGAKNVGVVIFSIQDPANTFNVLSATGSSRSVYPVMSSALNNSSWKFSTRMQKIDPALNVTSGPLISHVLVDIYYE

SEQ ID NO: 15 - protein, 204 aa, Escherichia coli
MTMMILKKLCYGLSGSLFLASSLFTIPSHAATDSIGLTVTTDVEMGTCTSTLTDDGTTKISTINFGDVYISEINAKTKIKTFKLQFKDCAGIPGKKAKIKLTTRALCEGNSNNGPGFANASTATAKAAAVAVEVWSTSTPGKNGAKQFSCVTPATEEVSIANATGSNVVDYPMSAVLVVAKDKTVTNVTAGDFTAPATFTVTYN

SEQ ID NO: 16 - protein, 188 aa, Escherichia coli
MIKITPHKITILMGLLLSPSVFATDVNVDFTATVKATTCNITLTGTNVTDNGNDKYTLVIPSMGMDKIANKTAQSEANFKLVANGCSSGISWIDTTLTGNQSGSSPALIIPLASDTTSTTSYIGMGFKRKATSGDTFLKPNSTEYIRWSASEISTDGLEMTVALRETSVGQGVPGKFRALATFNFSYQ

SEQ ID NO: 17 - protein, 862 aa, Escherichia coli
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIEQEGNIRITWIEEGKPVSCFAHYQQNTTSEKIAQSIILNGLRCQIQ

SEQ ID NO: 18 - protein, 246 aa, Escherichia coli
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 19 - protein, 204 aa, Escherichia coli
MEYYSRIFMSKKLGFALSGIMLAMAAGTAFAANDMDGGQLNISGLVVDNTCEARVDGGNKDGLILLQTATVAEITDGVLDTTVGAKAKPFSITIDCSKANPAPGTTAKMTFGSVFFGNSKGTLNNDMSINTPSDGVNIALHNIEGSTIKQVQVNNPGDVYSKTLDSTSKSATYDFKASYVRADASKAATAGYVKTNSAYTITYQ

SEQ ID NO: 20 - protein, 159 aa, Escherichia coli
MTVAYIAIGSNLASPLEQVNAALKALGDIPESRILAVSSFYRTPPLGPQDQPDYLNAAVALKTTLAPEELLNHTQRIELQQGRVRKAERWGPRTLDLDIMLFGNEVINTERLTVPHYDMKNRGFMLWPLFEIAPELVFPDGLSLVEALQAKGFNELDKW

SEQ ID NO: 21 - protein, 60 aa, Escherichia coli
MAEQFWKVPLVFLWCKVNDNVNENDYYKDEIIFETLAGSQAVRNLRIPEGSINNQMKRKG

SEQ ID NO: 22 - protein, 752 aa, Escherichia coli
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23 - protein, 114 aa, Escherichia coli
MLVFSVCHPVCHCRPACTGSPEIASDNSLTSHLAGSAPGLVSGDDVVQLINQLRSLEYDLCSSLLKILNHKHLILIVVAVPVFMNMVSQPTGNVSAVVGNRLPVKDHQHSLKVC

SEQ ID NO: 24 - protein, 115 aa, Escherichia coli
MLPNSRQPTLHHRLLPLPTYVRCSTAHITEKDNAWLYSLSHQTNDFGESEWIHFTGTGYLLRTDAWSYPVLRLKRLGLSKTFRRLVVTLIRCYGVGLIHLAASAGCLPGLPTFDW

SEQ ID NO: 25 - protein, 282 aa, Escherichia coli
MPESRLQGHAASALALQQRFCHYPQCAVELNIGVDAVNGTGVDTFSFCTATGNPAFQHILLDGLISTPQVLTVILPASWRQNVGGGDGPMFVTITVSQCRLCQRLACRWRQNQRLHGITHLLYPVKHAHHLVSPFNDSVHHISPVRNTHFPQRLTTDASVLADEPEVTRQHLVAGGTVMRVEQNNFRDMFSVYLSVTAQAQHVFCVSPAARVAHTGLAGEEWLKAFPLQAFQYGDGGDVRIVLASGRVFLFPENPRHMVHQLFMCQWTVTAYLVRSITKTTG

SEQ ID NO: 26 - protein, 161 aa, Escherichia coli
MVSNNLRRIFIMKHRHILTFFVAFLFMTIVPDSDAALVKRPEKGRAPFPEYVEFAQNRNQFPCNARLRFKGLCFVEQTDPWGAASVVRIPFNSPNGKGRLNAYGVVVHAIMVGDVVVGGSYSTGKNVTWNFDTFYREGKRRGKVTFYVDGKYWHYRDYPLE

SEQ ID NO: 27 - protein, 82 aa, Escherichia coli
MKIKTILYTIILFCEIGITDTYALGGSDIRHCEPTEESVIINPDESPVLIYSFSKHEVYKLMQGDTCTGLVISDKKPKPVHV

SEQ ID NO: 28 - protein, 212 aa, Escherichia coli
MHEMKHFLILVIGLLISITATAESLGQFEEDITGFPQGVWFYKEKAGWKNETGYKKEYLNSLLYKAEEIANYPGNRYTIYRSKNSSIIFVADNETRTFYLLNNKDALWSDIQIGYWAENKNSCHYVFVDTQYLAQSNELDEFFRTGVLDTHGVGESDRKVKEIRQKHKTHVLLRLPAQCVNDAILSRMNKSERRDLMKAQEDFKQYLARMEL

SEQ ID NO: 29 - protein, 168 aa, Escherichia coli
MVKIDLFNFGEKIMRLSNIFLAVVLTVTVSVAHAIPNMWGSGFTMGVTEFSIDNGKWGINISCTGNPNENNVLAHTIYIYKGDKVVANSEEKNISFVIDGEEFWGVVPDGTRMNDNAWVSFVKAISTATGFELYINEKKVATFNPSAKNVKKVMDNNFIQSCWNTWYE

SEQ ID NO: 30 - protein, 367 aa, Escherichia coli
MMFDVDDTAPDTPAPRELSQDVQALINNGLDFLDKAREELEASKPKFSVVSFWTAVEILLKVPLAHEHWSLVCSPKKPIKKQAYLAGDFQSVTYEETRERLKDVLERPLDRETDSAFDKVRKHRNRVVHFYHPTFTEAEQRQILKEQADAWFALNRLLRDEWKVIFGVKHNWKLAFGETRLIRGNKFYAEVRFKQVKPELEQLSEKNIQIGNCNECHQHATVTGTETTGNENRKLEVTRCKVCTSAVRQITLVCPDCEIPQLLPEGDSDFECEHCDYTSDRYKLLDEELFHSVDEQLLSVFPAGCTNCMTPESVCKFGDGYLCTQCFIYYTELHVCGCCGHLSDSVPELSHIRGCEFCDGDQRYFDD

SEQ ID NO: 31 - protein, 245 aa, Escherichia coli
MSHPPKKLKKSLITVFLSGILAVLGYFVALNGVFDLYQHIADNFLQKKAEDNLHVIYTGASIKYIESIFGPPVKEEHSEDGRVHEYIYSFKKFYLQVVYDNNNTVILYSVTSKDENFHPEVPYLRKTLGHKFKDFGSDIDYLQSSYSSKFYQYEEGHYLGNPGNYRNFYLAYNPAGVDYFELDPLPDLSNDDKSPPNKNDLEKFRNNNAPNTFGVGDIHGGPEGLELSFGLGIDYYDARDIPDKD

SEQ ID NO: 32 - protein, 269 aa, Escherichia coli
MSLPVPFGAIVTVVKKCWSTLTQIMLIKTYQLSHERWAVRHRLGASWHSLGNYLEYSLRFAQLTDKEPRCSRIAFRSKEERLQQVELVFEAIGSGLRYQETLCIHDVNNSPIILTLSNIPTLDVLILDDGFAFTVEQYQLKYCTIKLMTGESISIDNSPKYSLMQNWCLNDTWKRRWGIIWNCNAIECARRRIAEYWKWGFCLPLVGRPPLYSPSRKGIHLFEAKPLRWFMTRPWCLNIQFWTAIWSGLFILSDENVLQWRWKEPPQQD

SEQ ID NO: 33 - protein, 721 aa, Escherichia coli
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 34 - protein, 330 aa, Escherichia coli
MMKLSRLFPLLALLLAASLHAENTHKEVRIASPWPAQNTIIAMLGYGDNIVGTSMIAKRIPLFRQSLPRIEKVAAVSVNSGHEINPEQIIALGVDMLFVPQNMVVPQQALLKQAGVQVLAFEANSLRALTQRVQQTAAVLGPDAQQKALAYQRYFDRNVALVTGRLKDLPASQRVSLYHSMGNPLTTTGRPSLNQDWIDLAGGKNIAENWFGEHQQNRSGEVALEKIVTANPAVIIAMNKRDADAILSSPQWASVDAVIHHRVYVNPKGMFWWCRETSEEALQFLWLAKTLYPARFADVDIRKETREFYRQFFGLTLSDAQMSDVLNPPR

SEQ ID NO: 35 - protein, 352 aa, Escherichia coli
MTVLESTLSVENRYRQLFRQRLVILAVIFIAIIASLLLDFTLGPSGLPLHSLIKTLMHPSGATNGMRVIVWDIRLPYALMALLVGMALGLAGAEMQTILNNSLASPFTLGVSSAAAFGAALAIVLGIGIPGVPESGFIPANAFLFALLSALLLDSLTRWTRVPTSGVVLFGIALVFTFNALVSIMQFVADEDTLQGLVFWTMGSLARASWEKLAVLAAAMAIVLPWSLRRAWQLTALRLGEERAMSFGIDVRRLRLGSLLRISLLAALSVAFVGPIGFIGLVAPHISRLLLGEDHRFYLPGSILIGGLVLSLASVASKNIIPGVILPVGIVTSLVGVPFFLSIVMRHRGSMS

SEQ ID NO: 36 - protein, 141 aa, Escherichia coli
MPQNPGTPAQSFHSTVFLGGTTTSGNTFRLFVDFSGQFQRNGTISTFITPFLLLPGTFQFIHNIAALLAFLPILKMRTKHPYMMYRLNCQGLVSESLRLACSFRNVPVMKNRKFSLCCKMYPLILRFRFLCVFNSLYLLSF

SEQ ID NO: 37 - protein, 504 aa, Escherichia coli
MTEENRRIKAITRFSYGSGNLIGSGALAISGAWLLYFYTTFCGLTVFQATVIFSIATYLDVILNPLMGFITDNFYQTKLGRRFGRRRFFILIAIPCMIIYPLLWVNGMSFWYYLSTYIIFEVVYTMIMIPYNTLPVEMTKDFNQRTYLTGSKAMFGKVANFLAAAIPGIYFYFFNKDSATPFFLTGLTYAIIMITSLIMLYFNSWERPTDDVVDESTHGFMEGFNKLFTDLFSTFKLKTFRTHLGMYLFGFGAEWLFTATFTYFIVFNLEQPRTFVSEMNSLSSICQFFSTAFFMMWCAKRGFKRPFIIAILIVVSSVIGYVGVYYLNIPHLTWLIIGITIWFGLGTGGVYYIPWSVYVFLADVDEVLTGRRREGLYAGAMVMAGKLMRATVVFCLGVVLSLFGFESGIHHQSASAVNAINGVMIFGVAGMALIGIYFSVKMKLDKASHAEITKELERLKKGGRKEDATPEIRKLVKQLTGYEYDQCFGNNNVGFKFENKAGAF

SEQ ID NO: 38 - protein, 768 aa, Escherichia coli
MNMTSASVITMLALNLKTKQGHSRMNKHTLLLTVLFLNLICTPVFAQNWQVATFGQSTDLNFSSLIDSAKIGRNNAWLAGNNNFLEAGKFYTLPTDFFIESRGGKIANSHDGMTVFYTIVPVTQTFRLEADLTLEQIGPEVNGKSPAGQEGAGLFVRDIIGPQRQEPQSAGTEEYPQASNILMNAFITQNKKNDNLVQITSIVREGVIKTWGNEGITIKKQPIIENINFTQKRNIHMTIERLPEKFILTAFDTDRKENQSWQFSDYSGFMNQLDNNSLAIGFFAARNAKLRVKNASFKPGKPLVDYKQLTSRQFSRVRHKAPELFLASPQSVVRNSTTLQFLANQAGIVSIDNDKQTKQVQAGELVQFPVTLQKKHNDFTVNFNVDGNISKKAIRIEQVKSNLTDPYEIYVCSDCRQGARGSKNDPVDLQTAVKFVAPGGNIYLNDGQYHGITLDRELSGIPGKYKTISAINPHKAIFINKTFNLDASYWHLKSVVFDGNVDNGNNKPAYLRIAGSYNIIEHVIARNNDDTGISISAKDKNRFFWPAHNLVLNSDSYNNLDLSGINADGFAAKLGVGPGNIFRGCIAHNNADDGWDLFNKIEDGPNASVTIENSVAYENGLPYNKADILKGSIGNGFKLGGEGQPVNHKVINSIAINNNMDGFTDNFNTGSLIVRNNIAMNNARYNYILRTNPYKFPSSILFDNNYSIRDDWENKIKDFLGDTVNSVNYKLLVSHETGPVQKDLFFTRDDSGNIIYPDFFLNIINKFN

SEQ ID NO: 39 - protein, 40 aa, Escherichia coli
MFFLQSNWKLYQFTRLHLLSLLIIINTDYSSLIGQKLKSC

SEQ ID NO: 40 - protein, 326 aa, Escherichia coli
MLWDFMMLKKTIFILTLFSGNVIAATVELGFENEQYNYAYRSADVFMPYIKSNFNPVTDSALNVSLTYMYQDQYGKKHKKTSEDRFKTNRDRIELYLKGYTLNRGAYSFSPSAGFRYESWDVNYDNPKKQDKWKLELRFYPNMTYKLNDQLSLYMNGFVAPVFFKTQQESRKDNNYVKGKLGAKRYNNDYYQELQILGVRYKFNNDNTLWASVYNERKYNQHSSKYDRWQLRGGYDFKVTEEFVLSPFIRYDLSYREKNLESTSNNGLSKNNKEIRTGASFSYKIIPSVKLVGEIYRQTTNIENYYGEHSEDKNRMFYKLGINKTF

SEQ ID NO: 41 - protein, 142 aa, Escherichia coli
MFFTLLSLIIIQLFVPYLLGVRKTEEWIVSQMSFSGAILWIKIFSSVFLVPVYEEIVFRGCLFNSFKLWFHDNIYIPAIVTSVIISALHLQYTYFRTFLMLFLVSLVLISAKIKSNGLLMPILLHIAMNVAIAGIQYLAYIN

SEQ ID NO: 42 - protein, 156 aa, Escherichia coli
MSCYMKIYWTRKSIPELSALPPSLRKKNFTDTYNAASSHIEYWIGAGVSFISMMILFRVYDFLLPAQDTFPGDIIRSLCVVCPSILIWFQFSVYVMRKYYRHILVRGKETETISERLIREADTREYELWRPVRRFFSILFLIVLLVCIHSLITTIK

SEQ ID NO: 43 - protein, 79 aa, Escherichia coli
MRNLHVFPVTSALRHMVIATCVVSLDNKGIYSQVKCLIKYTNLVIINIYSGRMTREVDGQQTQSVIYSLLNKTLDVSRL

SEQ ID NO: 44 - protein, 261 aa, Escherichia coli
MMETKQKERIRRLIEILKKTDRIHLKDAARMLEVSVMTIRRDLHQEDEPLPLTLLGGYIVMVHKPAPSMPVIQDVPRNHRDDLPIAILAAGMVNENDLIFFDNGQEIPLVISMIPDAITFTGICYSHRVFVALNEKPNVTAILCGGTYRARSDAFYDASNSSPLDSLNPRKIFISASGVHDHFGVSWFNPEDLATKRKAMARGLRKILLARHALFDEVASASLAPLSAFDVLISDRPLPADYVTHCRNASVKVITPDSEDE

SEQ ID NO: 45 - protein, 438 aa, Escherichia coli
MNDKNIIQMPDGYLNKTPLFQFILLSCLFPLWGCAAALNDILITQFKSVFSLSNFASALVQSAFYGGYFLIAIPASLVIKKTSYKVAILIGLTLYIGGCTLFFPASHMATYTMFLAAIFAIAIGLSFLETAANTYSSMIGPKAYATLRLNISQTFYPIGAASGILLGKYLVFSEGESLEKQMSGMNAGQIHNFKVLMLENTLEPYKYMIMILVVVMVLFLLTRFPTCKVAQTSHHKRPSAMDTLRYLARNPRFRRGIVAQFLYVGMQVAVWSFTIRLALELGDINERDASNFMVYSFACFFIGKFIANILMTRFNPEKVLILYSVIGALFLAYVALAPSFSAVYVAVLVSVLFGPCWATIYAGTLDTVDNEHTEMAGAVIVMAIVGAAVVPAIQGYIADMFHSLQLSFLVSMLCFVYVGVYFWRESKVRTALAEVTAS

SEQ ID NO: 46 - protein, 418 aa, Escherichia coli
MDFFRFLMSDVLSEPAVLVGLIALIGLIAQKKPVTECIKGTVKTIMGFVILGAGAGLVVSSLGDFANIFQHAFGIQGVVPNNEAIVSVAQKSFGKEMAMIMFFAMVINIMIARFTPWKFIFLTGHHTLFMSMMVAVILATAGMTGVTLIAVGSLVVGVAMVFFPAIAHPYMKKVTGSDDVAIGHFSTLSYVLAGFIGSKFGNKEHSTEDMNVPKSLLFLRDTPVAISFTMSIIFLVTCLFAGADAVKELSGGKNWFMFSIMQSITFAAGVYIILQGVRMVIAEIVPAFKGISDKLVPNARPALDCPVVFPYAPNAVLVGFLSSFAAGLIGMFTLYLLNMIVIIPGVVPHFFVGAAAGVFGNATGGRRGAILGAFAQGLLITFLPVFLLPVLGDIGFANTTFSDADFGALGILLGIIVR

SEQ ID NO: 47 - protein, 3216 aa, Escherichia coli
MHQPPVRFTYRLLSYLVSAIIAGQPLLPAVGAVITPQNGAGMDKAANGVPVVNIATPNGAGISHNRFTDYNVGKEGLILNNATGKLNPTQLGGLIQNNPNLKAGGEAKGIINEVTGGKRSLLQGYTEVAGKAANVMVANPYGITCDGCGFINTPHATLTTGKPVMNADGSLQALEVTEGSITINGAGLDGTRSDAVSIIARATEVNAALHAKDLTVTAGANRVTADGRVRALKGEGDVPKVAVDTGALGGMYARRIHLTSTESGVGVNLGNLYARDGDITLDASGRLTVNNSLATGAVTAKGQGVTLTGDHKAGGNLSVSSRRDIVLSNGTLNSDKDLSLTAGGRITQQNEKLTAGRDVTLAAKNITQDTASQINAARDIVTVASDTLTTQGQITAGQNLTASATTLTQDGILLAKSHAGLNAGTLNNSGAVQGATLTLGSTTLSNSGSLLSGGPLTMNTRDFTQSGRTGAKGKVDIMASGKLTSTGLLVSDDALVLKAQDVTQNGVLSGGKGLTVSAQTLSSGKKSVTHSDAAMTLNVTTVALDGETSAGDTLRVQADKLSTAAGAQLQSGKNLSINARDARLAGTQAAQQTMVVNASEKLTHSGKSSAPSLSLSAPELTSSGVLVGSALNTQSQTLTNSGLLQGEASLTVNTQRLDNQQNGTLYSAADLTLDIPDIRNSGLITGDNGLMLNAVSLSNPGKIIADTLSVRATTLDGDGLLQGAGALALAGDTLSQGSHGRWLTADDLSLRGKTLNTAGTTQGQNITVQADRWANSGSVLATGNLTASATGQLTSTGDIMSQGDTTLKAATTDNRGSLLSAGTLSLDGNSLDNRGTVQGNHVTIRQNSVTNSGTLTGIAALTLAARMASPQPALMNNGGSLLTSGDLTITAGSITSSGHWQGKRVLITADSLANSGAIQAADSLTARLTGELVSTAGSKVTSNGEMALSALNLSNSGQWIAKNLTLKANSLTSAGDITGVDTLTLTVNQTLNNQANGKLLSAGVLTLKADSVTNDGQLQGNVTTITAGQLTNGGHLQGETLTLTASGGVNNRSGGVLMSRNALNVSTATLSNQSTIQGGGGVSLNATDRLQNDGKILSGSNLTLTAQVLANTGSGLVQAATLLLDVVNTVNGGRVLATGSADVKGTTLNNTGTLQGADLLVNYHTFSNSGTLLGTSGLGVKGSSLLQNGTGRLYSAGNLLLDAQDFSGQGQVVATGDVTLKLIAALTNHGTLAAGKTLSVTSQNAITNGGVMQGDAMVLGAGEAFTNNGTLTAGKGNSVFSAQRLFLNAPGSLQGGGDVSLNSRSDITISGFTGTAGSLTMNVAGTLLNSALIYAGNNLKLFTDRLHNQHGDILAGNSLWVQKDASGGANTEIINNSGNIETHQGDIVVRTGHLLNQREGFSATTTTRTNPSSIQGMGNALVDIPLSLLPDGSYGYFTREVENQHGTPCNGHGACNITMDTLYYYAPFADSATQRFLSSQNITTVTGADNPAGRIASGRNLSAEAERLENRASFILANGDIALSGRELSNQSWQTGTENEYLVYRYDPKTFYGSYATGSLDKLPLLSPEFENNTIRFSLDGREKDYTPGKTYYSVIQAGGDVKTRFTSSINNGTTTAHAGSVSPVVSAPVLNTLSQQTGGDSLTQTALQQYEPVVVGSPQWHDELAGALKNIAGGSPLTGQTGISDDWPLPSGNNGYLVPSTDPDSPYLITVNPKLDGLGQVDSHLFAGLYELLGAKPGQAPRETAPSYTDEKQFLGSSYFLDRLGLKPEKDYRFLGDAVFDTRYVSNAVLSRTGSRYLNGLGSDTEQMRYLMDNAARQQKGLGLEFGVALTAEQIAQLDGSILWWESVTINGQTVMVPKLYLSPEDITLHNGSVISGNNVQLAGGNITNSGGSINAQNDLSLDSSGYIDNLNAGLISAGGSLDLSAIGDISNISSVISGKTVQLESVSGNISNITRRQQWNAGSDSQYGGVHLSGTDTGPVATIKGTDSLSLDAGKNIDITGATVSSGGDLGMSAGNDINIAANLISGSKSQSGFWHTDDNSSSSTTSQGSSISAGGNLAMAAGHNLDVTASSVSAGHSALLSAGNDLSLNAVRESKNSRNGRSESHESHAAVSTVTAGDNFLLVAGRDIASQAAGMAAENNVVIRGGRDVNLVAESAGAGDSYTSKKKKEINETVRQQGTEIASGGDTTVNAGRDITAVASSVTATGNISVNAGRDVALTTATESDYHYLETKKKSGGFLSKKTTRTISEDSATREAGSLLSGNRVTVNAGDNLTVEGSDVVADRDVSLAAGNHVDVLAATSTDTSWRFKETKKSGLMGTGGIGFTIGSSKTTHDRREAGTTQSQSASTIGSTAGNVSITAGKQAHISGSDVIANRDISITGDSVVVDPGHDRRTVDEKFEQKKSGLTVALSGTVGSAINNAVTSAQETKESSDSRLKALQATKTALSGVQAGQAATMASATGDPNAMGVSLSLTTQKSKSQQHSESDTVSGSTLNAGNNLSVVATGKNRGDNRGDIVIAGSQLKAGGNTSLDAANDILLSGAANTQKTTGRNSSSGGGVGVSIGAGGNGAGISVFAGVNAAKGSEKGNGTEWTETTTDSGKTVTINSGRDTVLNGAQVNGNRIIADVGHDLLISSQQDTSKYDSKQTSVAAGGSFTFGSMTGSGYIAASRDKMKSRFDSVAEQTGMFAGDGGFDITVGRHTQLDGAVIASTATPDKNHLDTGTLGFSDLHNEADYKVSHSGISLSGGGSFGDKFQGNMPGGMISAGGHSGHAEGTTQAAVAEGTITIRDRDNQKQNLANLSRDPAHANDSISPIFDKEKEQRRLQTVGLISDIGSQVADIARTQGELNALKAAKEATGETLPANATEKQRQEYLAKLRDTQAYRNEMAKYGTGSEIQRGIQAATAALQGLAGGNLAGALAGASAPELAHLLKSTEKDPAVNAIAHAILGGAVAAMQGNNVAAGAAGAATGELAARAITGMLYPGVKQSDLSEEQKQTISTLATVSAGLACGLTGNSTASAAVGAQSGKNAVENNSLSDGWNNILPSGTQDYGQAVASWNQYAQDNNLTPEQVQEGMNRIAIGEGPSWGTTYKVHPVVQAGGDVSFIRGYTLSGTIDDNHISVNQGDIYSIGAHGGASIGLSFGPYFPGLINSNDNDYSINGGFGVGAVGLSTGKDGVSFTFGFGPSWGWSATEIKGVDVNGTSTSEVYRYDFK

SEQ ID NO: 48 - protein, 1371 aa, Escherichia coli
MNKVYSLKYCPVTGGLIVVSELASRVIKKTCRRLTHILLAGIPAVYLYYPQISQAGIVRSDIAYQIYRDFAENKGLFVPGATDIPVYDKDGKLVGRLDKAPMADFSSVSSNGVATLVSPQYIVSVKHNGGYQSVSFGNGKNTYSLVDRNNHSSVDFHAPRLNKLVTEVIPSAITSEGTKANAYKDTERYTAFYRVGSGTQYTKDKDGNLVKVAGGYAFKTGGTTGVPLISDATIVSNPGQTYNPVNGPLPDYGAPGDSGSPLFAYDEQQKKWVIVAVLRAYAGINGATNWWNVIPTDYLNQVMQDDFDAPVDFVSGLPPLNWTYDKTSGTGTLSQGSKNWTMHGQKDNDLNAGKNLVFSGQNGAIVLKDSVTQGAGYLEFKDSYTVSAESGKTWTGAGIITDKGTNVTWKVNGVAGDNLHKLGEGTLTINGTGVNPGGLKTGDGTVVLNQQADTAGNVQAFSSVNLASGRPTVVLGDARQVNPDNISWGYRGGKLDLNGNAVTFTRLQAADYGAVITNNAQQKSRLLLDLKAQDTNVSVPIGSISPFGGTGTPGNLYSMILNGQTRFYILKSASYGNTLWGNSLNDPAQWEFVGTDKNKAVQTVKDRILAGRAKQPVIFHGQLTGNMDVTIPQLPGGRKVILDGSVNLPEGTLSEDSGTLIFQGHPVIHASVSGSAPVSLNQKDWENRQFIMKTLSLKDADFHLSRNASLNSDIKSDNSHITLGSDRVFVDKNDGTGNYVILEEGTSVPDTVNDRSQYEGNITLDHNSTLDIGSRFTGGIEAYDSAVSITSPDVLLTAPGAFAGSSLTVHDGGHLTALNGLFSDGHIQAGKNSKITLSGTPVKDTANQYAPAVYLTDGYDLTGDNATLEITRGAHASGDIHASAASTVTIGSDTPAELASAETTASAFAGSLLEGYNAAFNGAITGGRADVSMHNALWTLGGDSAIHTLTVRNSRISSEGDRTFRTLTVNKLDATGSDFVLRTDLKNADKINVTEKATGSDNSLNVSFMKDPAQGQSLNIPLVTAPAGTSAEMFKAGTRMIGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 49 - protein, 53 aa, Escherichia coli
MTALMYFCDVCYIVKYFSFAYKITAPAIFFTYAVLFLYVFITATINYTRDFYL

SEQ ID NO: 50 - protein, 98 aa, Escherichia coli
MAWHRGHCCGMLIVNLDTHRPLVLLHGRDQHTLATWFRKYPEIQVVSRDRCGINATAAREGAPQARQVAERWLLLNNIGDAPERMMYRHMTLIRLVTS

SEQ ID NO: 51 - protein, 415 aa, Escherichia coli
MKRKHLLLLLLFSFSTNSAPLYSLIREAVMHDPIVMEARAELTSAQSRIEQASSAHWPVVTATGSKLLSQSHRYSYDYDTEDILPGIRGEVNIFASGAIEADVRRSESEAEYYHYKMEETKEETIHSFVSLYLDALREKQSIAVLEQSLSRHNAILNDLNTISIHDTGRESELVQAEARRLMVRQQINSRSRVLKTTLGKLSTWTKNPVTEADLENPFSRMTEAKLLTDFTQAPQKGNPSWLASQADVESKKAALKAQELARYPRVDLTGSVTRDDQQIGVNLSWDLFNRNASYGVTEKAAQIVAATGRLDSVARMIDETGRLSLITVRQSRGEMETLRRQEQASARVVDFYRLQFQVARKTLIELLNAENELYSVGLSRVQTEDQMLHGMLDYLYSQGMLLKWSGVNLSGEEEK

SEQ ID NO: 52 - protein, 715 aa, Escherichia coli
MKSIFEGLSQITALLGTPVSAETLAAGTVRTDVSGIDFRSVGEFLRSEGFDNHLSRRSPEDIPSLAVPALLLLNAQEAIVVVRIEGAGLARQYHVLQPGGLRKTLSHDALMAVYSGYCWFVQPQAKQDRRSELPEYDMSGAWFWRVLWRFRAYYGQVIVASFIINFLALVSSLYVMNVYDRVIPNRSWETLWMLSIGVITAILFECAAKLIRSYLTDVAGKKADLIISSALLRRVMAVKMSDRPASSGSYASNLREYESVREFMTSATLLAFVDLPFILLFISVIGLVGGWLAVVPLTLVPLVILAGILLQRPLSRHINASMRESSQRQGLLVEALDGIETLKLNNAVNWVQRRWDGYTASVARSSIRVKNTSNVIISFSTAIQQINTVLLVILGTYLIHSDDPHNRITMGALIAAVILSGRALAPLGQIASLATRFQQARLAMQGVNEIVRRPVERESQTHYLTVKDIQGEFHFSAVTFFYKPELPAALKGMSVCIRPGEKVGIIGTIGCGKSTLLKMMVGLYRQNKGQITLDGVAMQQLDPCFVRDKVFLLEQNPRLFLGTLRENLQLSRLPGSLSDVDMINAAGRFGFDRFIRHHPCGLDMQIGEGGQGLSGGQRQMVALTRMVLGSPRVVLLDEPTTGLDLQTENIVLKGLNHWSRGRTMVVVTHRLQVLNIVDRIIVMNEGRVMMDGPRDEILKKLSGKQQSGESRAITS

SEQ ID NO: 53 - protein, 420 aa, Escherichia coli
MDRRGMTEKTERNKASSEVVRQSDLALLTDVQAALQQEKHHALFLMVIFLLVLVVTFVIWAWNSPLDEVTRGQGSIIPGSREQVIQTLDPGILKTLEVREGDIVEKGQVLLTLDDTRSSAMLRESEARVNNLEAVRARLRAEAYSESLTFPDDVPADLRERESTVYRLRKTELAQSIAGLKQSKALLDKEIAMTRPIVREGAMSEVELLRMQRQSAELQLQMDEKQNKYLTEAGAELVKTEAELAQAKENMAGRADPVERSRIRAPLRGIVKNIRVNTLGGVVSAGQDIMEIIPLEDQLLIEAYINPRDVAYVRTGMPALVKLTAYDYAIYGGLDGVVTLVSPDTLRDQKRPGDLKLDPNEAYYRVLVTTSNNYLTDRNGKILPVIPGMIASVDIKTGQKSVFQYLIKPITRMKQALQER

SEQ ID NO: 54 - protein, 1610 aa, Escherichia coli
MKMIFTGKVSGEKTVLTVGGRHTVKAQPGEQYGLIDEVTGLVPDGVEADRSGDDLILRKKEEDTEVRIEGFWEECQPGETQCTAVFNIVGEDGQVTEAVLTQDGPVLDDITAGQSGTLSDDDRGGFIWLGGLAFGGGLAAMALAAGGGGSKHRHENDDSDTTAPSSPALKAEDDGSVSVELPGDANKGDTVDVTFEDEKGGKHTVTLEKGDNGWTSSDPTLIPDSTGDKATIPADNVKDNSEVTGVAKDPSGNESDPSTVTSKTDGVADAPVLSIPEVTDGYANADELKDGLQAEVTLPAGTAEGAVITLTVTRPDKTTENVTHTVTKDEVAAGKVSMDIPKDAVIDGQNSVSVTLTQGSNPAKPGNVVDFAADTQIPGDTDGDGATDATPVVAIPEAADGVNAEELKDGVQTEVTVPKGSAAGDTLTLTVTKPDGTTDTVEHTLTADEVAAGKADVTIPADKVTADGQYSVTAEITDPAGNTSGQGQPADFAVDTVAPSAPVLKAEDDGSVSVELPGDANKGDTVDVTFEDEKGGKHTVTLEKGDNGWTSSDPTLIPDSTGDKATIPADNVKDNSEVTGVAKDPSGNESDPSTVTSKTDGVADAPVLSIPEVTDGYANADELKDGLQAEVTLPAGTAEGAVITLTVTRPDKTTENVTHTVTKDEVAAGKVSMDIPKDAVIDGQNSVSVTLTQGSNPAKPGNVVDFAADTQIPGDTDGDGATDATPVVAIPEAADGVNAEELKDGVQTEVTVPKGSAAGDTLTLTVTKPDGTTDTVEHTLTADEVAAGKADVTIPADKVTADGQYSVTAEITDPAGNTSGQGQPADFAVDTVAPSAPVLKAEDDGSVSVELPGDANKGDTVDVTFEDEKGGKHTVTLEKGDNGWTSSDPTLIPDSTGDKATIPADNVKDNSEVTGVAKDPSGNESDPSTVTSKTDVLPTVSISVETTSTDVNGDGFTGIASVNGTVMDVPATIEDKDDSTGLVYTVSLNHVTTTDVTVTVTLGSGAGHSDAADYSDIGGAQHNGKIGLHGDTGKVTYDGATTVTIVIPAGSKSVSFIVDPTLEANQDAFNAEGMEKVVATITGTSDNVTAATDIVDNAGASATGVIYDGNAISLRNLDGDFTLKYSLSSSIAEKGDFGYTIGANSGENDPMVTTDYNDTVYVGYYQSGKETTSYSNVANSQDNGPDGTKTDGNQSITTVDLGAGDDLMVIRGNMLANTRVYTGEGNDTFTMDGMNTALRVMYAGSYIFTESGDDIVTIKRTGVTNAGQIYLGSGSDTFIQGDATDNNDTTLSGLLDLGSGTKDISNMPKEYLSVYQDGSNLSLGNDNNIDTATDVNTVTIYGSVSGEILGGYGSDNITVTKNLTGNISVGDNADTLTAGWIYGGSTVSMGDGNDTVTITDGAYNTTISLGAGDDVFDATSGVMGDSAYATVVNGEDGNDTFKLGTIAKNLTIDAGAGDDIVVLTKDYDSTSSGNQGYINGGEGSDTLVLTGTISVNLAAGKNEGIAGFEKVDMTVGSDLKADNAAQLVKLTASDVLGINDNSTIYISGDANDKVDLGADGAGSLGTFTATATTVKATALDGIEHTYTLYSSVSGANVYIDNNIIDANGVI

SEQ ID NO: 55 - protein, 89 aa, Escherichia coli
MGALNLKSPERPLISEYPTINALSISRFFNEIRKVYPDYNQTVNIILDGARYHHAQLVTDWAEVVNIKRVQLALIYIIIDLCKITVYHY

SEQ ID NO: 56 - protein, 158 aa, Escherichia coli
MLRNMKIFISDLQKAELERLHDTSRNKRVCDRIKAILLASEGWSSVMIAQALRLHQTTVDHHIHEFMNKGKLKPENGGSDSKLSAEQTSLLIKHLSDNLFHHTHEIIAFVLHTWGILFSVAGMNKWLHRNGFSYKKPAGTPHKFSEERQAQFIEFMKT

SEQ ID NO: 57 - protein, 41 aa, Escherichia coli
MEVLQKRADGLLLLPVICDNFVQMLQLNAYPVLITEMEISQ

SEQ ID NO: 58 - protein, 1376 aa, Escherichia coli
MNKIYALKYCYITNTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPATVTSSSTADILNPSKYSAFYRAGSGSQYIQDSQGKRHWVTGGYGYLTGGILPTSFFYHGSDGIQLYMGGNIHDHSILPSFGEAGDSGSPLFGWNTAKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTRPADVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINEIFNGGIQANNSTVNISSDSAVLENSTLTSTALNLNKGANVLASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 59 - protein, 65 aa, Escherichia coli
MLIFILNCVAVQSGYIYHHTIICFSEVQISFNTLFSIFVDYNSLFNVFTNGIIRRSNGFSRWWGN

SEQ ID NO: 60 - protein, 60 aa, Escherichia coli
MQAGKHRTKPISCSKMASGLICHGGFEPHAWGVASLMDVTVLVVASLLVWLLVNRENHYA

SEQ ID NO: 61 - protein, 329 aa, Escherichia coli
  Xaa 271, 277, 296, 302, 308, 315, 318, 325, 327: Xaa is any amino acid
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGVELHGAHGFLLQNFFSPLFNQRNDRWGGDLEGRMRFPLAVLQEVKNVVYEYATKPFAIGYRISPEESVTGGLRIEDTYKLLDRLISSGISYIHTSLVSIXIATLLXLPNGPRTIELILNHIAGRXTGNRRXKIHTPXQAQEAIXRWXATCCDPXKXWR

SEQ ID NO: 62 - protein, 306 aa, Escherichia coli
MKTVSIKHTYWDIAADIYFPDDFNSEKKYPAIISAHPIGSCKEQTSGSVYGAALAKAGFIVIAFDASFQGSSGGEPRYLEDPTMRVKDFSIVVDYLTTLPYVDAGRIGVLGICGGGGYAINAAMTERRIKAIGTVTGANYGRLMREGFTAFNPIGALEAMAQQRTDEANGAKLRVDDLLPSSPEAALEAGLTEIDLFEATEYYRSPRGCAPNGVNRSLFSHQTVAVGWDAFHLAEVLLTQPLMVVVGDRVGAFGAYRDGCEIIGRAASKHKELVVVEGYSHYDLYDKPEPVKQALDKLIPFYKTHL

SEQ ID NO: 63 - protein, 283 aa, Escherichia coli
MQKVKLNNGIEMPLLGFGVFQMTDAAECERAVIDAINSGYRLIDTAASYQNEIQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLQAVPWMQSRGIQPEAWAPFAEGKNGLFQHPVLTAIGEKYGKSVGQVVLRWIYQRGIVSLAKSVRKERMEENINILDFELSPEDMLQITALDTATSAFFSHRDPAMVEWLTGRKLDV

SEQ ID NO: 64 - protein, 776 aa, Escherichia coli
MKLVTRMENFFMKNSKVFYRSALATAIVMALSAPAFATDSTVSTDPVTLNTEKTTLDQDVVINGDNKITAVTIETSDSDKDLNVTFGGHDITAASTVNQDFVEGVKVSGNKNVVINATDSTITAQGEGTYVRTAMVIDSTGDVVVNGGNFVAKNEKGSATGISLEATTGNNLTLNGTTINAQGNKSYSNGSTAIFAQKGNLLQGFDGDATDNITLADSNIINGGIETIVTAGNKTGIHTVNLNIKDGSVIGAANNKQTIYASASAQGAGSATQNLNLSVADSTIYSDVLALSESENSASTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 65 - protein, 253 aa, Escherichia coli
MRFVLFCPSGIVPAQFAALSTGSVGNVTCIRTEEELRNKLRHRPQSVVISAGRPAECAEMWFRFYRDHSFVVVLCVAPFFLPPDVSISGVLKNLRLLKPGMSVERVISIANASGGFSGLKHAEILPVMDSYSVFMKEVNNCTKTIVMSERFPEKQKKVLSLLLAGHSWEYSAQFLKTGIRQIWLAEQSLKKRWGIPDSMSLREALLLSSNNFHGDGNALETTNAMTLRENGNTNRYSVVVNAGTQALSLHKYK

SEQ ID NO: 66 - protein, 51 aa, Escherichia coli
MCLLLISYVYLAMPDMSSRQNASIEYSQYLNHPIQPQHAASLNETEQQRSP

SEQ ID NO: 67 - protein, 109 aa, Escherichia coli
MQRCNGFLISGIALTAGAPLCISWFGLVGFYFGALSLVAAAVISWIVYFWLIYLVLTRPHNQRFVERFILIVGICFFPWSIVLIWAFFASSARAHNQHAEQIKNSTTDG

SEQ ID NO: 68 - protein, 625 aa, Escherichia coli
MSASSVKPLNVQLPAITLILFALCVGIFCYLAQWMSYEEVDQSALIHLGANVASLTLSDESWRLLSSVFLHSSFSHLLMNMFALLAVGTVAERILGKWRLLIIWLFSGIFGGLISACYALRESEQIVISVGASGAIMGIAGAAIATQLASGAGTHHKNQRRVFPLLGMVALTLLYGTRQTGIDNACHIGGLIAGGALGWLSARLVGQNRLVTEGGIVVAVTLLLTGTIWFVQQQIDESVLQVRQSLREAFYPQEIEQERRQKKQQLVEERNALRETLSAPVSREQASGDLLAEIADIHDMAISRDGNTLYAAIENTNSIVVFDLGQKKILHTFTAPIAKEKSVKHCGGCKDQGVRSLALSLDEKLIYATSFEANALSVINVATGEIIQSITTGAHPDSFILSRDGTKAWVMNRTSNSVSAIDLVAYQHVADIPLEKYDGTGMSGKPGAWVMALSPDEKTLLVPGAGRGNIVRINTITHQKEDFPAGNARGVVSAMGFRPKNGEIIFADSQGISRIRAEDQQASIMTQWCSRSVYSVEGISPDGQYLALVSYGLQGYVILLNINAGQIIGVYPASYPNNVRFSADGRKIFVMAKNGLIQLDRESSLDPQAIIRHPQYGDVACIPEP

SEQ ID NO: 69 - protein, 426 aa, Escherichia coli
MTMEMILALGILVLMIVLIMSDKMPFGAPPLLACLLLVVSGLSTVQQAFAGFVNPSVVMIAGFMVVMAALQKTRLISNVKSAMISLVNKGSYRSYGLLLVIVMLGASLAGTGATGYYVLILSLVSTIPYSKKLPTSKLMMPLGFATNHPLLPINLALLFGVTATVLETAGFHQEISMGRFALVNLIMSAAFLAWSLIAYRFLPDHPIADASEDALAAREETFNALPAWKEYCTIAAFAVSVIGMMLMNILGNIAFVIPGLAGAFVLMIDVLDFKEVRDHMGAPVILMMAGVIGVADALAGTGFTAMVGDAVAGVLGSGVSPFVFIVAFALLTSTCATFTGSNMGSVYIFAPIAIAACTSLGLNPTAAAIAVVISGWNGGYMPIDGMPAMILGMGKYKLPEFWVFSVPMYLIRILALCAGAVFIFPM

SEQ ID NO: 70 - protein, 252 aa, Escherichia coli
MFLWFMQPDIWLTLITLTFLEIILGVDNIIFLSLVVAKLPLSQQNMARKLGLSCAMIMRILLLISIAWLSHITQPLFTVLTLEISFRTLILLGGGLFLIYKAIQEIREELSPAQEDEHGSGSRQLSLCGAIVQIMLLDIVFSLDSVITAVGLSQHIFIMIAAVMIAVGVMMFAAKTIGDFVNATPSIKILALTFLLFVGVLLVADSLNIHIAKEYLYFAIFFSLSVETLNIIRERKNKKVSTLLETHESHSH

SEQ ID NO: 71 - protein, 295 aa, Escherichia coli
MPKTIEGVLTAIVTPFTATGSLNIPALKVQVNRQLEAGNAIFCGGTNGEFFVLNEQEKLSVTQTCVDEVAGRAPVVAHIGEISTRETIRLGQQIEKLGVDAVSVIAPYFVPLKQEELIAHYSAIADALSIPMFLYNIPARTGNTIQPETARALASHPNIIGIKDSAGSDESLKGFLDAVRDIDGFNVLNGPDSLIHKGFVEGCSTCISGLANIAPREINAIWSRFHAGDIEGSYEAQESVTGLRTDLYKVAFSPAAVKKALQLMGHDVGDSRYAVNFTPEQISEIQQIIRHYNIN

SEQ ID NO: 72 - protein, 385 aa, Escherichia coli
MVIINSTILSGAGAIPSLTSLLPDIRKMLLVTDRNIAQLDGVQQIRALLEKHCPQVNVIDNVPAEPTHHDVRQLMDAPGDASFDVVVGIGGGSVLDVAKLLSVLCHPQSPGLDALLAGEKPTQRVQSWLIPTTAGTGSEATPNAILAIPEQSTKVGIISQVLLPDYVALFPELTTSMPAHIAASTGIDALCHLLECFTATVANPVSDNAALTGLSKLFRHIQPAVNDPQDLRAKLEMLWASYYGGVAITHAGTHLVHALSYPLGGKYHLPHGVANAILLAPCMAFVRPWAVEKFARVWDCIPDAETALSAEEKSHALVTWLQALVNQLKLPNNLAALGVPPEDIASLSEAALNVKRLMNNVPCQIDLQDVQAIYQTLFPQHPFKE

SEQ ID NO: 73 - protein, 328 aa, Escherichia coli
MNNIIAVTMGDPAGIGPEIIIKSLSEAGLAGAPVVVVGCVRTLRRIMAMNITPQAELRVIQKVCDAHFAPGVINVMDEPLANPDALTPGVVQAAAGDLAYRCIKRATALALSGEVKAIATAPLNKEALHLGGHNYPGHTELLAHLTGSKEYAMVLYTDKLKVIHISTHISLRKFLDTLNGERVKTVIRVANHFLKRVGIERPRIAVAGVNPHAGEHGLFGTEEIEIIAPAIEAMQAEDIDVTGPCPPDTVFMQCHEGLFDMVVAMYHDQGHIPLKLLGFYDGVNITAGLPFIRTSADHGTAFDIAWTGKAKSESMAVSIQLAMQISRE

SEQ ID NO: 74 - protein, 50 aa, Escherichia coli
MTSIASYRAGLGYCICKKQTTDLFISGGVLLFSGVINFSFEKLRTCYYLK

SEQ ID NO: 75 - protein, 117 aa, Escherichia coli
MEQMRRQRALTPIITLPKFMELLDRTLMHCSIINSLFTMPFYNNESGIIFLNFIFLLVFLVKLSIIHCSIILRMMEIEGFLMIIKHILMLFNHEFFNMIMYQYIILPDVLLNYRLLL

SEQ ID NO: 76 - protein, 323 aa, Escherichia coli
MDSKEHKKETIQNSITKSEFKKYVDFIHDDSIPLPEHERTYLKNLLKNGEIEEFKDQYRRHLQNLDRVGFSDEDIELQLNVLKKDNNEFRNLLRFYTARLSDLQESNTSLSLKNKELENLNIEKESLLEQTFSRIKELEASNNELTSRAHQERIDQKIPEYVNSVKDDLGDDDDHFISLAKTWAIAGAIAGLSAVIFSFISLYFVTDFINAKGFELFYLFTRGLIGISILSWLSYICLSISKKYTHESIRRKDRRHALMFGQVFLQIYGSTATKEDAIQVFKDWNMSGDSAFSDQMDYPPSFQTLWSTAKEKIKPSHSEKSSD

SEQ ID NO: 77 - protein, 67 aa, Escherichia coli
MRDPRDINNEQNKRALAAIFFMAKIPAERHSISINELTTDEKRELIKAMNHFRAVVSLFPRRLTMPN

SEQ ID NO: 78 - protein, 260 aa, Escherichia coli
MGPLVIMVVLVCGFWYTENHYQSRIRQARSNGWNSYFYVAMHGCKFAIQGFTLMAVTFVILLVISSVINVFGYFWPKLHVDFYSWLTDVKIMSYPLFFVLSMLLAVFIAYDQGNNARRAIENEEIRQSAYREMAAQDGIESLLVQAIDEGKLIFVTLKSRKVYIGYVAAPRMEHQETQHLALIPYISGYRDKDTLRYHEQHRYYELYLSKNITADSTPLNLNHFRHVIPMDQVESISIFDTETYKSFEDFSTPDQTKVTA

SEQ ID NO: 79 - protein, 53 aa, Escherichia coli
MRKRFAFTVMSRAPLEKTYWSLMVAVMGAVKQCAVFVPTTTQTAGGESLHSRL

SEQ ID NO: 80 - protein, 430 aa, Escherichia coli
MQQHQVIARRVANTAALAGGLFSLNAQAMLPCWTQAHGLCSGFCGGGAEVANLDVFHQCCAAVVLNHIGFVNGFKVFNPVTFRVVDNRTAAGVLLPVNGQVIQTGDQQRIRREERRTHGLQAPHALLTDDHIGSQFFTVFLLFVDQREILVRQQFTTANHHQIVIVLVDHVDKLIDCIHHHCVQVGIFATFPDFHRTRCGFTARGGAAHDVIRCIFTDFLQPAFVHILQQRVFATVGGFRTLHAVKADHYAVQSLTFHDGVTDAHLEILKLRPQVQLRVGQHRVKVGLLAFIFHINHQRRIDRLTLFRGGVSGSGNGAANTQPQQLTRLLSHWRDVNQRQESGGLLDLVFQRLLYRRLYSELAGQFFNCHTVQTRQLLQVSVKSKAGILLHRVLCSISNWSECQRGRYRLLHAGGSPGGCLHDSACPPVR

SEQ ID NO: 81 - protein, 71 aa, Escherichia coli
MTLERISAFITYCIAVVLAWLGDLSIKDASTLGGLMIGVLMLAINWYYKHKAYRLLRDGQISREDYESINR

SEQ ID NO: 82 - protein, 170 aa, Escherichia coli
MNPSIVKRCLVGAVLAIAATLPGFQQLHTSVEGLKLIADYEGCRLQPYQCSAGVWTDGIGNTSGVIPGKTITERQAAEGLISNVLRVERALERCVKQQPPQKVYDSVVSFAFNVGTGNACSSTLVKLLNQRRWADACRQLPRWVYVKGVFNQGLDNRRAREMAWCLQGAN

SEQ ID NO: 83 - protein, 139 aa, Escherichia coli
MRGRWPGVYREQTEMKKKLISGLFLMLWMALLIAAMVYPQGIFPVLAASGVWVACLLTWAVIPVALAALIKNSPLWQELRASLLKTITRKENVFISWVMRLLIVVSLAWTGWAITLVFYLLTVIAFWITRNQMAQQVAA

SEQ ID NO: 84 - protein, 142 aa, Escherichia coli
MNRLLLVVLALLLAALGWQTWRLADASQTISTQSDELQSKSQALAKSNSQLISLSILTETNNREQARLYAEAEQTSALLRQRQHRIEELKRENEDLRRWADTPLPADIIRLRERPTLTGGAAYRQWLSASDAVSAGAGNAAH

SEQ ID NO: 85 - protein, 185 aa, Escherichia coli
MLQLVSVLIQRSPRQPLQNHVAGHCLNIIIYTQKATLCVTDLRSFAADAITQAIMVNAGNALHLTFKLYAGRIRAGGGFQVFCGAQLCKHLTFDAPFFTSCCYPSRLIAAAVRVALHPDILLLCPAQFLRQLAHHAASGGWLQIRQQSTQPVVHLLQFSHVSPSTFLQVHRVPLQLQRSTHCRQC

SEQ ID NO: 86 - protein, 479 aa, Escherichia coli
MSTKFYTLLTDIGAAKLASAAALGVPLKITHMAVGDGGGVLPTPDAKQTALVNEKRRAALNMLYIDPQNSSQIIAEQVIPENEGGWWIREVGLFDESGALIAVGNCPESYKPQLAEGSGRTQTVRMVLITSSTDNITLKIDPAIVLATRKYVDDKALELKVYVDDQMAKHLAAPDPHSQYAPKASPTFTGTPKAPTPAAGNNTTQVATTAFVQAALTALINGAPATLDTLKEIAAAINNDPNFSTTINNALALKAPLSSPALTGTPTAPTAAQSVNNTQIATTAFVKSAIAGMVGSAPAALDTLNELAAALGNDPNFATTMLNALAGKQPLDNTLNNLSGKDVEGILTYLGLGHLGNAAGRNVGNANSYEIPDMSYFQLTGKGSDNLLVKGPNGLIIQIFRRNLPNSTTIGIPQQLAITYPTPFPNGVWGVFVTKMTYAQVVTSCESIYNDGFTAVTCLTSGTSSDSKVSSAVFIAFGY

SEQ ID NO: 87 - protein, 343 aa, Escherichia coli
MKRDISLDLLRIICCIFVIGIHVTPDYAYTVTSNQTESIQIQTLFAQSIVRIGLPIFFMLSGYYLLNRQNSTPLLFYKKRIPAIIIPFVIYSLAHYYIISWNNGTSSNLLEYFSLISKSTISLSVHFWFVYAFIGLYLTAPAIQYIVNKIPQADSLKVIIVLAFIFYYSLYSYSLSQSSQYYHHLIPLQSIDTWVLYFVVGGLLKRVDIKTHYIVYSIPFIFLLHVMFVYFSVNKYNFNIYPFDSGINMLLLCSLIVIAFTKININNKKIILTIEKIAPLTYGIYLIHVCVFRVLEKYFNIPFIVDNILLKTTSLSLVIFFISLGLSLIIDRLFVNPILRLNR

SEQ ID NO: 88 - protein, 194 aa, Escherichia coli
MNGLFSLLIAHFAVLSIGFWRGIPRRSDISEAEGVAVRFHQVHTVHNFHHVDKVHFIEHLTIDGQLRVAVGTGYFGGVAFARLPLAGIHFFVTSTHDKLHGLHFPGIVTLNRAGKAQLDAIHRGFTHLFKQQQFSTTNGKFCVQRTVIKPQIHIHRTRHSAAAILLIFAGKFRQRQRLNDPLPVVPVVKQVQVF

SEQ ID NO: 89 - protein, 151 aa, Escherichia coli
MSLSTALRMTCRRRLLSLIVGPASLNRFIPPFQHFGQRHNVSNGWRPVKNGGDICHQIVNRQAVGKPASTDFFNKKVTTSTDMAVRSAGSISAISCAVSAGLEMRGITVIIAFTSISIMACRRVPRSAPDCGLRSTISVISVLPRLMGVSS

SEQ ID NO: 90 - protein, 947 aa, Escherichia coli
MLSQELGAMGPPSQRQVVALGRQRLAVQRLEERQKKLQQQTALVRAELYRAGISAKDDAGATARLARETSRYNQELSKQEARLKRLGEAQRRMNAARASYARSLEVRDRIAGAGATTTAAGLAMGAPVMAAVKSYTSMEDAMKGVAKQVNGLRDDNGNRTARFYEMQDAIKAASEQLPMENGAVDFAALVEGGARMNVANPDDSWEDQKRDLLAFASTAAKAATAFELPADELSESLGKIAQLYKIPTRNIEQLGDALNYLDDNAMSKGADIIDVMQRLGGVADRLDYRKAAALGSTFLTLGAAPEVAASAANAMVRELSIATMQSKSFFEGMNLLKLNPEVIEKQMTKDAMGTIQRVLEKVNALPQDKRLSAMTMLFGKEFGDDAAKLANNLPELQRQLKLTAGNDALGSMQKESDINKDSLSAQWLLVKTGAQNTFSSLGETLRQPLMDILYTVKSVTGALRRWVEANPELTGTLMKASAVVAAVTVGLGTLAVALAAVLGPLAVICLGFSVLGIKTLSSVTAAVTRTSSALSWLAGAPLALLRRGLASSGNAAGLLTAPLSSLRRTASLTGNVLKTVAGAPVALFRSGLSGLRAVAVMFLNPLAALRGGLTAAGSVLRVLASGPLAMLRVILYAVSGLLGALLSPIGLVVTALAGVALVVWKYWQPITAFLGGVVEGFKAAAGPISAAFEPLKPVFQWIGDKVQALWGWFTDLLTPVKSTSAELQSAAAMGRRFGEALAEGLNMVMHPLDSLKSGVSWLLEKLGIVSKEAAKAKLPESVTRQQPAKVNADGKVMMPSGGFPSWGYGFAGMYDSGGYIPRGQFGIVGENGPEIVNGPANVTSRRNTAALAAVVAGMMGVAAAPAELPPLHPLALPAKGGEVIVSRAATVPLVQRIEAPTQIIIQTQPGQSAQDIAREVARQLDERERRLKAKARSNYSDQGGYDA

SEQ ID NO: 91 - protein, 161 aa, Escherichia coli
MMMVLGLYVFMLRTVPYQELQYQRSWRHAANSRVNRRPSTQFLGPDNDMLTLSGVLMPEITGGRLSLLALEQMAEQGKAWPLIEGSGTIYGMYVIEGLNQTKTEFFRDGMPRRIEFTLSLKRVDESLSEMFGDLRSQLNNLQDTATSALSDISKTVGGLLP

SEQ ID NO: 92 - protein, 83 aa, Escherichia coli
MNLAKMGRTRKMMICPLCGSAAHTRSSFQVSSLTKERYNQCQNINCSHTFVTHETFVRSIATPKESNPVQPHPMKSGQVALSL

SEQ ID NO: 93 - protein, 130 aa, Escherichia coli
MVAKQFGEVSEWLKEHAWKVCIRQRIGGSNPPLTAIFKEELVRKYEFFSHFICLYGSERQLSQPLQDCSFLSCLYGSELKYYTFSPLLIKQNHLIFLLSPFFILTFSSSTNYQQLTFTSKNRVFTVPPHK

SEQ ID NO: 94 - protein, 100 aa, Escherichia coli
MLCRTFREQSVQIAAIAFLFAKFIRHRFYQHTNRRRSIEFQIEITHKTHHFPVFWRQRNPFVLCNHHRQWLTPLAAFFEIAFGIRFYLFTFEDQHNSLLP

SEQ ID NO: 95 - protein, 605 aa, Escherichia coli
MYNFITIMYDVFSYFGVLAKNQNTRDIRNIKNFSSHQHSLGDMFDELINIIDKEQVLSTEQRKVIFRRYEDLYVKLMHYSVFTDKTHQIIKQKYFNDIVPMILALDIRNTYRPDNEMAFYYHIHSFLTQIPDNEDDIYHAARTYQRNYVKLCLSGYTPANAHFKYIFDGVYEFIRNIRKNSTPGKTKLTATINTCKETCKHLLYLSNEDKEKIISDLDKIQVACYYLTILLAFERRTSLTSALATLYKMLISEREVSEYECQLLYLTNPIDVMNTLNKYIYYFPNENSPFYTLKIDSALSWEAIDAIRDYSISDIYLYPEQKTINCVVEIENIVFGGYIYTLNNGVTLQNIENTLKDSSCHYVLNGYTEFVNCLIQLTSGKTESVHRTINKLNYEKLPFGFIIAAFAILKIAFKIKFSKNHVNIRALLNDINYFMTYQGESINLISLDHEYPESCLQNDTNTYLLGRVIFLYNSMIYKFINCQEHETNNIHSAMINNLLQEVDIALGKINNIIDSRNISAPHELANILTREKILTAREKKGNLISLFDGFTLFHCVGMITFLIHYLRTPEEKVENIFMLYGADKNNKLRRRLIYDALGIIQSQQE

SEQ ID NO: 96 - protein, 54 aa, Escherichia coli
MLILQTCVFQLNYIYETRKPGIKEQIVEMVHNGAGVRDSSRTLKVDINTVILTL

SEQ ID NO: 97 - protein, 486 aa, Escherichia coli
MKREAFMCLLAPENPYPIYALPPLVRNAIIETQKNTQAPLAMVATSALTATSIACQNQVDVCRPGNLRGPVNLYSLILADSGERKTTVDKVFMKAFYLRDEALAEEYAKLVENYSTEKEIWEQKQKALESKFHKEIRAGKDYKATESELETHLNKSPVPPQIRRTIFNETTIEGMLKYYSDSNRSFALVSSEGGVIFDSRAMSKLGIINTLWDGGSLFIDRKSSPGINLKEPRLTMSAMIQPDVYHKGFCTRKKELVKTSGHHARFLMCQPTSTQGTRIITGDNYSSQYQELFDKRINELIDESLAMSGERRCLHFSPQAARIWTDYYNDVESKLGGLGPLRHCREYAAKNAEYMARLAGLLHHLSSEEGDISPYTAEMGRELAIWYGNEYMRLSNPLTFDNTAQNETMRLIPEELELFNWIKSYCIEKGIPCMKKNDILQRGPNRFRKKDKINWLLDLLYEQNRVVPVIEGKTLCVAPNFDLLMT

SEQ ID NO: 98 - protein, 666 aa, Escherichia coli
MYKTVKTTYRLILALSATGWSDPPTECSNITDKDLTPMKKVLTLSLLALCVSHSAVAANYTFNNDNIALSFDDTNSTIVLKDRRTNHPITPQELFFLTLPDETKIHTADFKIKHIKKQDNAIVIDFTRPDFNVTVQLNLVKGKYASIDYTIAAVGQPRDVAKITFFPTKKQFQAPYVDGAITSSPIIADSFFILPNKPIVNTYAYEATTNLNVELKTPIQPETPVSFTTWFGTFPETSQLRRSVNQFINAVRPRPYKPYLHYNSWMDIGFFTPYTEQDVLGRMDEWNKEFISGRGVALDAFLLDDGWDDLTGRWLFGPAFSNGFSKVREKADSLHSSVGLWLSPWGGYNKPRDVRVSHAKEYGFETVDGKLALSGANYFKNFNEQIINLIKNEHITSFKLDGMGNASSHIKGSPFASDFDASIALLHNMRRANPNLFINLTTGTNASPSWLFYADSIWRQGDDINLYGPGTPVQQWITYRDAETYRSIVRKGPLFPLNSLMYHGIVSAENAYYGLEKVQTDSDFADQVWSYFATGTQLQELYITPSMLNKVKWDTLAKAAKWSKENASVLVDTHWIGGDPTALAVYGWASWSKDKAILGLRNPSDKPQTYYLDLAKDFEIPAGNAAQFSLKAVYGSNKTVPVEYKNATVITLQPLETLVFEAVTIN

SEQ ID NO: 99 - protein, 207 aa, Escherichia coli
MKHLTEMVRQHKAGKTNGIYAVCSAHPLVLEAAIRYASANQTPLLIEATSNQVDQFSGYTGMTPADFRGFVCQLADSLNFPQDALILGGDHLRPKSLVDSETLIVVYISSHPYTRQYDLGLLTELRRDRQAMRVIAIAVETDAIIEAGPHILLPPSRSFIDMEQAFCFLMYAQVFALAQSIHVGNTPDLPSASGTINRVVQGVIIHP

SEQ ID NO: 100 - protein, 409 aa, Escherichia coli
MTRRVVITGMGGVTAFGENWQDVSARLLAYENAVRKMPEWQVYDGLHTLLGAPVDDFTLPEHYTRKRIRAMGRVSQMSTRASELALEQAGLIGDPILTSGETGIAYGSSTGSTGPVSEFATMLTEKHTNNITGTTYVQMMPHTTAVNTGLFFGLRGRVIPTSSACTSGSQAIGYAWEAIRHGYQTVMVAGGAEELCPSEAAVFDTLFATSQHNDAPKTTPSPFDENRDGLVIGEGAGTLILEELEHAKARGATIYGEIVGFATNCDAAHITQPQRETMQYCMEQSLKIAGLSAQDIGYISAHGTATDRGDMAESLATATIYGDNVPVSSLKSYFGHTLGACGALEAWMSLQMMREGWFAPTLNLNKPDPNCGALDYIMHEARKVDCEFLQSNNFAFGGINTSIIIKRWP

SEQ ID NO: 101 - protein, 392 aa, Escherichia coli
MTDMIYISAVGMINALGNNLDEIATNLTRGVAPGMRPRAGWLQGHPQAVLAGVDGELPLIPEKFAAHRSRNNQILLAALAQLQPQVDDAIAKYGRERIAIVLGTSTSGLHEGDTHVNLRTHGQPSTTWHYAQQELGDPSRFLSHWLALDGPAYTLSTACSSSARAIISGRRLIEAGLVDAAIVGGADTLSRMPINGFHSLESLSPTLCQPFGRDRAGITIGEGAGLMLLTREPQPIALLGVGESSDAYHISAPHPQGEGAIRAINQALTDAQLTPDDVGYINLHGTATQLNDQIESMVVNALFGERVPCSSTKHLTGHTLGAAGITEAAISMLILQRDLPLPAQDFSLSPRDPTLPPCGIIEKPQPLARPVILSNSFAFGGNNASILLGRVS

SEQ ID NO: 102 - protein, 194 aa, Escherichia coli
MIKSTFWRALALTATLILTGCSHSQPEQEGRPQAWLQPGTLITLPAPGISPAVNSQQLLTGSFNGKTQSLLVMLNAEDQKITLAGLSSVGIRLFLVTYDAKGLRAEQSIVVPQLPPASQVLADVMLSHWPISAWQPQLPTGWTLRDNGDKRELRNASGKLVTEITYLNRQGKRVPISIEQHVFKYHITIQYLGD

SEQ ID NO: 103 - protein, 772 aa, Escherichia coli
MTNTNVLPPSKRPALLWGLVCLVMAAALLILLPQSRLNSSVLAMLPKQVMGDIPPALNDGFMQRLDRQLVWLVSPGKEANPRVAQEWLTLLQKSAALGDVKGPMDAASQQSWGAFFWQHRNGLIDPDTRARLQNGGEAQAQWILSQLYSAFSGVSGKELQNDPLMLMRGSQLAMAKNGQRLRLMDGWLVTQDPQGNYWYLLHGELAGSSFDMQQTHQLITTLNTLEKDLKTRYPQAQLLSRGTVFYSDYASQQAKQDISTLGVATLLGVILLIVAVFRSLRPLLLCVISIGIGALAGTVATLLIFGELHLMTLVMSMSVIGISADYTLYYLTERMVHGNDVSPWQSLAKVRNALLLALLTTVAAYLIMMLAPFPGIRQMAIFAAIGLSASCLTVLFWHPWLCRGLPVRPVPAMALMLRWLAAWRRNKKLSRGLSVALALFSLAGMSMLRVDDDISQLQALPQHILAQEKAITALTGQSVDQKWFVVYGDSPQQTLRRLEKFTTSLEKAKKDGLISKYRTIPLNSLARQEEDLHLLTTAAPTVTKALQNAGLTTVNPDLNAMPVKVDEWLASPASEGWRLLWLTLENGASGVLVPVEGVKNSAALQEISSYYPCGIAWVDRKNTFDELFALYRYVLTGLLLVALAVIACGAVARLGWRKGFISLVPSVLSLGCGLAVLAISGQAVNLFSLLALVLVLGIGINYTLFFSNPRGTPLTSLLAITLAMLTTLLTLGMLVFSATQAISSFGIVLVSGIFTAFLLSPLAMPDKKRTKK

SEQ ID NO: 104 - protein, 201 aa, Escherichia coli
MKFLPLLALLISPFVSALTLDDLQQRFTEQPVIRAHFDQTRTIKDLPQPLRSQGQMLIARDQGLLWDQTSPFPMQLLLDDKRMVQVINGQPPQIITAENNPQMFQFNHLLRALFQADRKVLEQNFRVEFADKGEGRWTLRLTPTTTPLDKIFNTIDLAGKTYLESIQLNDKQGDRTDIALTQHQLTPAQLTDDEHQRFAAQ

SEQ ID NO: 105 - protein, 540 aa, Escherichia coli
MMPGVLARLKPFNLPCIVVDDGSDAATQQQLDNLVSEQPGVTLIRLAENAGKGAAVMRGLQAAADAGFSHAVQVDADGQHAIEDIPKLLALAEQHPAALISGQPIYDDSIPRSRLYGRWITHVWVWIETLSLQLKDSMCGFRVYPVAPTLQLAKRATIGKRMDFDTEVMVRLYWQGNTSYFVPTRVTYPLDGLSHFDALKDNVRISLMHTRLFFGMLPRIPSLLMCHSSSHWARQSEVKGLWGMRLMLLVWRLLGRTAFTALLYPVVGVYWLTAARARKASQDWLARVRQQQPQAAKINSYQHFLRFGNAMLDKIASWRGELQLGRDVLFAPGAEAALDVRDPRGKLLLASHLGDVEVCRALAKIQGYKTINALVFSENAQRFKQIMQEMAPQAGINLMPVTDIGPETAILLKEKLDNGEWVAIVGDRIAVNPQRGGDWRVCWSPFMGQPAPFPQGPFILASILRCPVNLIFALRQHGKLHIHCETFADPLLLPRGERQQALQNAIDHYAARLEHYALQSPLDWFNFFDFWQLPEIQDKE

SEQ ID NO: 106 - protein, 452 aa, Escherichia coli
MNQTLSLSQWLTASRPVTTPVAWLGEYTWTLGHLRHDVALLIDHLRDQPGNRWALCFENSYLFIVALLATLHSGKIPVIPGHNRAALLNVQRSLFDCVLSDKRLGWNGPQFVVSTSHQMTTSTIAFDDIASDAFIELFTSGSTGQPKQIAKPLISLDQEANMLATHFADRLLGCRFVASVMPQHLYGLTFRIFLPMALGLPLHAAMLWYSEQLAALSHTYRYAFVSSPAFLKRLDLHLTPPPVEMILSAGGMLPWQDVEKTSTWLNIWPDEIYGSTETGILAWRYRQQDNIPWFTFSDVHLSQESEGVRVFSPLIPAEGLVLDDMLQFNENGQFHLIGRRGRVVKIEEKRISLVEIEQRLLALDGIMDVAAIPLIRNGRQAIGVVVVPNKEARQIWQCSGGKTLELSWRKALLPWLEPVAVPRYWRIIDEIPVNNMNKRVYAQLQELFHDTP

SEQ ID NO: 107 - protein, 194 aa, Escherichia coli
MMSGIRSLPMIKLLTGLLLLVWPFLIWLGLVHNSLHWLLPLMALLLLLRLRQPRRQTGPLQVVTKIVAVVGIVLCVSSFLLKTYQLLLFYPVVVNAVMLAVFGGSLRSTMPIVERLARLQEPDLPEKAVRYTRRVTQVWCLFFIFNGSIALFTTLYGNMPLWTAWNGIIAYLLIGFLTAGEWLIRRKMIKRKTP

SEQ ID NO: 108 - protein, 279 aa, Escherichia coli
MALEPQMSKLMSRLGWAWRLVMTGLCFVLFGLGGLLLSVVWFNILLVLVWDTSRRRRLARRSIAASFRLFLTVAKGLGVLDYRIDGAEILRQERGCLVVANHPTLIDYVLLASVMPETDCLVKSALLKNPFLGGVVRAADYLINSEAETLLPRCQQRLAQGDTILIFPEGTRTKPGEKMTLQRGAANIAVRCTSDLRIVTIGCSEHLLDKQSKWYDVPPARPFFTVEVHGRVEINKFYDATSQEPTLAARQLNRHLLLQLQQGCLPLSGINNASALSGN

SEQ ID NO: 109 - protein, 129 aa, Escherichia coli
MKRYIKWFAITIFISMLSACVRTAPVQQISTTVSVGHTQEQVKNAILKAGAQRKWIMTQVSPGVIKARYQTRNHVAEVRITYTATYYNIKYDSSLNLQASDGKIHKNYNRWVRNLDKDIQVNLSTGATL

SEQ ID NO: 110 - protein, 908 aa, Escherichia coli
MRCLSPVVICSGAALRGYAISPSPFFLVFLSPHFRLRQPCCLRVAGTLLNSALIYAGNNLKLFTDRLHNQHGDILADNSLWVQKDSSGTANSEIINRSGNIETMRGDITMNTAHLLNSWDAISASHEVIPGSSRGVISPVPENNRWWGVVRHDGVEYLAVYWGKGATVPDEYRIRTGDTDTVTVSATGHAARISGGADMHIRAGRLDNEASFILAGGSMTLSGDTLNNQGWQEGTTGKETVWRLASDSLPKAWFTEPWYRVYRQVSPDATEASGTSPVGQYRAVISAAGDVSASFATDTGNTTVMPRAGGSGNTITVPSLNSLTPPTVSQGVSGEALLNESGTGITGPVWNDALPDTLKDIPGALSLYGASVSSYPLPSGNNGYFVPSTDPDSPYLITVNPKLDGLGKVDSSLFAGLYDLLRMQPGEAPRETDPVYIDEKQFLGSSYILDRLGLKPEKDYRFLGDAAFDTRYVSNVILNQTGSRYINGTGSDLTQMKYLMDSAAAQQKALGLTFGVSLTAGQVAQLTRSILWWESVTINGQTVMVPKLYLSPEDITLHNGSVISGNNVQLAGGNITNSGGSINAQNDLLLDSTGSIDNLNAGLINAGGALNLKAIGDISNISSVISGKTVSLESATGNISNLTRTEQWAMNNGYNHFSGTDTGPLAAVRATDSLFMGAAGDISITGAAVSAGDSVLLSAGNDLNMNAIQAGERRRYGGSGWYETHAVAPTVTAGNSLMLSAGRDVNSQAAGITAENSMDIRAGRDVNMAAESTGAGDHDSTFSMKTVHDSVRQQGTDMTSGGDITVTAGRDITSVATAVTAKGDIRVNAGHDIVLGTATESDYHYSESGETRNRLLSHQTTRTITEDSVTREKGSLLSGNRVTVNAGDNLTVEGSDVVAEPGCVTGGG

SEQ ID NO: 111 - protein, 537 aa, Escherichia coli
MTPLLNKPECLPGDGGFDITVGKHTQLDGAVIASTATPDKNHLDTGTLGFSDLHNEADYKVSHSGISLSGGGSFGDKFQGNMPGGMISAGGHSGHAEGTTQAAVADGTITIRDRDNQKQNLANLSRDPAHANDSISPIFDKEKEQRRLQTVGLISDIGSQVADIARTQGELNALKAAKEATSETLPANATEKQRQEYLAKLRDTQAYRNEMAKYGTGSEIQRGIQAATAALQGLAGGNLAGALAGASAPELAHLLKSTEKDPAVNAIAHAILGGAVAAMQGNNAAAGAAGAATGELAARAIAGMLYPGVKQSDLSEEQKQTISTLATVSAGLAGGLTGNSTASAAVGAQSGKNAVENNSLSAGWNNILPSGTQDYGQAVASWNQYAQDNNLTPEQVQEGMNRIAIGEGPSWGTTYKVHPVVQAGGDVSFIRGYTLSGTIDDNHISVNQGDIYSIGAHGGASIGLSFGPYFPGLINSNDNDYSINGGFGVGAVGLSTGKDGVSFTFGFGPSWGWSATEIKGVDVNGTSTSEVYRYDFK

SEQ ID NO: 112 - protein, 77 aa, Escherichia coli
MENNQTAFRESMVSLLLMSVFHGNRQNNYYQLWQHNFNFNYSVSFFKGKMKLFILIHPIWASKKQMFYLYSSLLEGK

SEQ ID NO: 113 - protein, 43 aa, Escherichia coli
MSVEMMLKSSIVLEEFIMTIIGIVLARNVFAVHNVALNEKMFW

SEQ ID NO: 114 - protein, 97 aa, Escherichia coli
MGFEGFWSGQAGKTEVKYDGVYMREITESQLRYISGAGGAPATSANAAGAAAIVGALAGIPGGPLGVVVGAVSAGLTTAIGSTVGSGSASSSAGGGS

SEQ ID NO: 115 - protein, 424 aa, Escherichia coli
MFRQDALENRKMKWQGRAILLPGIPLWLIMLGSIVFITAFLMFIIVGTYSRRVNVSGEVTTWPRAVNIYSGVQGFVVRQFVHEGQLIKKGDPVYLIDISKSTRSGIVTDNHRRDIENQLVRVDKIISRLEESKKITLDTLEKQRLQYTDAFRRSSDIIQRAEEGIKIMKNNMENYRNYQTKGLINKDQLTNQVALYYQQQNNLLSLSGQNEQNALQITTLESQIQTQAADFDNRIYQMELQRYELQKELVNTDVEGEIIIRALTDGKVDSLSVTVGQMVNPGDNLLQVIPENIENYYLILWVPNDAVPYISAGDKVNIRYEAFPAEKFGQFSATVKTISRTPASTQEMLTYKGAPQNTPGASVPWYKVIAMPEKQIIRYDEKNLPLENGMKAESTLFLEKRRIYQWMLSPFYDMKHSATGPLND

SEQ ID NO: 116 - protein, 704 aa, Escherichia coli
MQQDRSMTNGNFRQIINQLDMRWRRRVPVIHQTETAECGLACLAMICGHFGKNIDLISLRRKFNLSARGANLAGINGIAEQLGMITRALSLELDELGALKMPCILHWDFSHFVVLVSVKRNRYVLHDPARGRRYLGREEMSRYFTGIALEVWPGGEFRTETQQTRISLRSLINSIYGIKRTLAKIFCLSAVIEAINLVMPVGTQLVMDHAIPAGDRGLLTLISAGLMFFILLRAAVSMLRAWSSLVMSTLINIQWQSGLFNHLLRLPLAFFERRKLGDIQSRFGSLDTLRATFTTCVVGAIMDSIMVVGVFVMMLLYGGYLTWIVLGFTMVYVLIRLVTYGYYRQISEETLVRGARASSYFMESLYGIATVKIQGMVGIRGTHWLNLKIDAINSGIKLTRMDLLFGGINTFVAACDQVAILWLGASLVIDNQMTIGMFVAFGSFRGQFSDRVASLTSFLLQLRIMSLHNERIADIALHEKEEKKPEIEIVADMSPVSLETTDLSYRYDSQSAQVFSGLNLSVAPGESVAITGASGAGKTTLMKVLCGLFEPDSGKVLVNGTDIRQLGINNYHRMIACVMQDDRLFSGSIRENICGFAEETDDEWMTECARASHIHDVIMKMPMGYETLIGELGEGLSGGQKQRIFIARALYRKPGILFMDEATSSLDTESERFVNAAIKKMNITRVIIAHRETTLRTVDRIISI

SEQ ID NO: 117 - protein, 228 aa, Escherichia coli
MEMTKNKNATIKKQSSAGCFSMFTLSFSITFIPAFLTNRQELISRGLLVPALFLAEFLILVPLYFIFFRKREGLGRGSFRLDVFFTLFSLIMIIQLFVPYLLAVRKTEEWMISQMSFSGAILWINIFSSVLLVPVYEEIVFRGCLFNSFKFWFNDNIYTSAIVTSVIFSALHLQYTDFHTFLMLFLVSLVLISAKIKSNGLLMPILLHMSMNAVIAGIQYLASISYTH

SEQ ID NO: 118 - protein, 156 aa, Escherichia coli
MSCYMKIYWTRKSIPEHSALPPSLRKKNFTDAYNAASSHIEYWIGAGVSFISMMILFRVYDFLLPAQDTFPGDIIRSLCVVCPSILIWFQFSVYVMRKYYRHILERGKETETISERLIREADTREYELWRPVHRFFSIVFLIILLVCIHSLITTIK

SEQ ID NO: 119 - protein, 170 aa, Escherichia coli
MQITEALISEPGDIRRFVQQAVDHWPHLLAFYFTLHSAEGNINGQQIHAFCTAFYRQVQEHITERNHTASPAPPVVLRWLREQHGGATIRCLLLLSQASICHLRVSATVDEECSQVVDLLQQAWRGINAGGQCRVERCFRVTRPDTSEQYVALKTAVQSLMPLVIATIIR

SEQ ID NO: 120 - protein, 180 aa, Escherichia coli
MKLKFISMAVFSALTLGVATNASAVTTVNGGTVHFKGEVVNAACAVNTNSFDQTVNLGQVRSERLKVDGAKSNPVGFTIELNDCDSQVSAGAGIVFSGPAVTGKTDVLALQSSAAGSATNVGVQITDHTGKVVPLDGTASSTFTLTDGTNKIPFQAVYYATGQATAGIANADATFKVQYQ

SEQ ID NO: 121 - protein, 174 aa, Escherichia coli
MAIMLFLLSPAALAGNHWHVMLPGGNMRFQGKIIAEACSLALSDRQMTVDMGQLSSNRFHAAGEYGDSVGFDIHLQGCSTVVSQRVGISFYGVSDIHEPELLSVDEENDASDGIAIALFNESGELVKLNQPPENWVHLTRGDMKLHMQARYKATHYPVTGGKANGQVWFSLTYL

SEQ ID NO: 122 - protein, 231 aa, Escherichia coli
MMKHMRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVKGVVK

SEQ ID NO: 123 - protein, 892 aa, Escherichia coli
MCLAADFIFSLSVGADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 124 - protein, 175 aa, Escherichia coli
MVKDIIKTVTFSCMLAGSMFVTCHVCAAGSVVNITGNVQDNTCDVDINSRNLDVSLGSYDSRQFTAAGDTTPASVFHVGLTSCGSAVSAVKLTFTGTPDNQEAGLIQINSINGARGVGIQLLDKDKHELKINVPTTIALMPGTQTIAFYARLKATYLPVKAGNVDAVINFVLDYQ

SEQ ID NO: 125 - protein, 167 aa, Escherichia coli
MKLKAIILATGLINCIAFSAQAVDTTITVTGRVLPRTCTIGNGGNPNATVVLDNAYTSDLIAANSTSQWKNFSLTLTNCQNVNNVTATFGGTAENTNYYRNTGDATNIMVELQEQGNGNTPLKVGSTKVVTVSNGQATFNLKVRAVSKGNAGAGSINSQITVTYTYA

SEQ ID NO: 126 - protein, 725 aa, Escherichia coli
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVVSWKLNPQQILDFEVGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKERLNWNTNATWMITSEQKDTGNPLSVIPKYTINNSLNWTITQAFSASFNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 127 - protein, 318 aa, Escherichia coli
MYAREYRSTRPHKAIFFHLSCLTLICSAQVYAKPDMRPLGPNIADKGSVFYHFSATSFDSVDGTRHYRVWTAVPNTTAPASGYPILYMLDGNAVMDRLDDELLKQLSEKTPPVIVAVGYQTNLPFDLNSRAYDYTPAAESRKTDLHSGRFSRKSGGSNNFRQLLETRIAPKVEQGLNIDRQRRGLWGHSYGGLFVLDSWLSSSYFRSYYSASPSLGRGYDALLSRVTAVEPLQFCTKHLAIMEGSATQGDNRETHAVGVLSKIHTTLTILKDKGVNAVFWDFPNLGHGPMFNASFRQALLDISGENANYTAGCHELSH

SEQ ID NO: 128 - protein, 1245 aa, Escherichia coli
MRDRSVLAFLRNDPASGSYFTDGGGLMPANHTPTPAQSWIVRLARVCWERKKLSVIVVVASVSTILLAALTPLLTRQAVNDALAGNPARLPWLACGLLLIAFFDFIGNYVRRGYAGMLSLWVQHTLRGRVFDSIQKLDGAGQDALRTGQVISRTNSDLQQVHTLLQMCPVPLAVFTYYIAGIAVMLWMSPAMTLIVVCVLVCLAITALRARRRVFAQTGMASDQLANLTEHIREVLAQISVVKSCVAEMRETHWLDRQSRQIVRVRIGAVISQAMPGATMLALPVLGQIVLLCYGGWSVMHGRIDLGTFVAFASFLAMLTGPTRVLASFLVIAQRTQASVERVFALIDTRSQMEDGTESINSQVVGLELENMSFDYHHGDRHILSDISFSLRAGETVAVVGASGSGKSTLLMLLARFYDPCSGKIWLNTSEGRQNLRDIRLEALRRRVGIVFEDAFLFAGTVAENIAYGHPQATADDIRRAAAAAGASDFINALPKGFDSLLTERGTNLSGGQRQRIALARALITAPDVLILDDTTSAVDAVTEAEINTALGRYADEGHMLLVIARRRSTLQLASRVVVLDKGRMVDTGTPAELEARCPAFRALMTGDSDFLATSHNSHNELWPAEPATQDDVTDTGDKGFVARMTRVPENAVQQALAGKGRKVTSLLKPVAWMFVIAALLIALDSAAGVGVLILLQHGIDSGVAAGDMSTIGLCALLALCLVIVGWCSYSLQTVFAARAAESVQHSVRLRSFGHMLRLGLPWHEKHADSRLTRMTVDVDSLARFLQNGLAGAATSLVTMFAIAATMFWLDPILALTALSAVPVAALATMIYRRLSTPAYAQARLEIGKVNSTLQEKVSGLRVVQSHGQQELEGARLRALSERFRATRVRAQKYLAVYFPFLTFCTEASYAAVLLVGASQVAAGEMTAGVLAAFFLLLGQFYGPVQQLSGIVDAWQQATASGKHIDELLATEGTENLGSSSVLPVTGALHLDEVTFSYPDSHEPALNKLTLTIPEGMVVAVVGRSGAGKSTLIKLIAGLYFPTHGNIRIGVQMLDDASLTEYRRQIGLVDQDVALFSSDIAENIRYSRPSATNEDVEIASQRAGLYEMVCNLPQGFRTPVNNGGADLSAGQRQLIALARAQLANAHILLLDEATSCLDRTSEERLMSSLTDVVHAGKHSALIVAHRLTTAQRCDLIAVIDKGLLAEYGTHEQLLSAGGLYTRLWHDSVSSTALHRQHNMKEETPG

SEQ ID NO: 129 - protein, 387 aa, Escherichia coli
MRRLPDLDRQAERDFLMRILFVGPPLYGLLYPVLSLAQAFRVNGHEVLIASGGQFAQKAAEAGLVVFDAAPGLDSEAGYRHHEAQRKKSNIGTQMGNFSFFSEEMADHLVEFAGHWRPDLIIYPPLGVIGPLIAAKYDIPVVMQTVGFGHTPWHIRGVTRSLTDAYRRHNVGATPRDMAWIDVTPPSMSILENDGEPIIPMQYVPYNGGAVWEPWWERRPDRKRLLVSLGTVKPMVDGLDLIAWVMDSASEVDAEIILHISANARSDLRSLPSNVRLVDWIPMGVFLNGADGFIHHGGAGNTLTALHAGIPQIVFGQGADRPVNARVVAERGCGIIPGDVGLSSNMINAFLNNRSLRKASEEVAAEMAAQPCPGEVAKSLITMVQKG

SEQ ID NO: 130 - protein, 99 aa, Escherichia coli
MKPTLLQTVENICLQILFVLFLFTGTLIDVEALVSCSSVAKNVQRTPASSVSSSVYSASVSRTAADIMLLSNNPLFAPGQVSFFGCSLAASGIHVTILE

SEQ ID NO: 131 - protein, 144 aa, Escherichia coli
MKDLSFIRFFLAILLLLVPPALEFPVIHRHITPGALTLCVITALIITLLASLGGRLVSVKCISEISFIRRHRIECMMAGFMIYFWTFSLIAGWYKPQFKKEYQTLHYENARYYVLARYDGRLVLSQSYRSGSRKFVIINGGHRL

SEQ ID NO: 132 - protein, 296 aa, Escherichia coli; identical to SEQ ID NO: 11

SEQ ID NO: 133 - protein, 656 aa, Escherichia coli
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 134 - protein, 263 aa, Escherichia coli
MMKNTGYILALCLTASGHVLAHDVWITGKQAENNVTAEIGYGHNFPSKGTIPDRRDFFENPRLYNGKETITLKPASTDYVYKTESASKDNGYVLSTYMKPGYWSRTSSGWKPVSREGRNDVAYCEFVTKYAKSFIPGEQQMPAQLYQSPTGHELEIIPLSDISRFSENVKLKVLYKTSPLAGAIMELDSVSYLTSSRHTHAVEHKHPVHKAELTFVTNEDGIVTVPSLHIGQWLAKVQNKKSFQDKSLCDETVDVATLSFSRN

SEQ ID NO: 135 - protein, 420 aa, Escherichia coli
MAWSQFPVILGITLTHRCPVNMNRIPVIIINGFLGAGKTTLMKNLLTQANRNHLAVSVIVNDMSDLDVDGVLIANTEIVNIANNNFVSITSDSISSQSGIKTVDKAIKNMLRHYLPDVIFVETSGGSHPLPLIKYLQTHERLQLKSLLSLVDTVMLNDDYNGGKALIPAFQENLFHGKRRIENLLAEQIMFCSTLLLTKKDRLSFDIVTDVAKAIHPLNPYVNVIAVSWGNLKLAELLTLPDYDFNRVGLLIRELEDTITVEEAKISAQNGEIISRVIKDDRPFHPQRLWETYHYFMGMGIYRSKGFFWLPGRPDMALLWNQAAGSINLEFISYWNSGVLADPDNHLTHEERSVLQKKVNKTMGRFGDRRCHLTIIGRSDEVHDFTSALINCFLSEEEIVWWQSGGVFADPWPVNISRLN

SEQ ID NO: 136 - protein, 378 aa, Escherichia coli
MGKIKYWLIVGFIILFAIFYIAISDRDSTLSRLKSAGENGDVEAQYALGLMYLYGEILDVDYQQAKIWYEKAADQNDPRAQAKLGVMYANGLGVNQDYQQSKLWYEKAAAQNDVDAQFLLGEMYDDGLGVSQDYQHAKMWYEKAAAQNDERAQVNLAVLYAKGNGVEQDYRQAKSWYEKAAAQNSPDAQFALGILYANANGVEQDYQQAKDWYEKAAEQNFANAQFNLGMLYYKGEGVKQNFRQAREWFEKAASQNQPNAQYNLGQIYYYGQGVTQSYRQAKDWFEKAAEKGHVDAQYNLGVIYENGEGVSQNYQQAKAWYEKAASQNDAQAQFELGVMNELGQGESIDLKQARHYYERSCNNGLKKGCERLKELLYK

SEQ ID NO: 137 - protein, 1091 aa, Escherichia coli
MQTHRHEIQGTTEPHVRNFHQPDLRHCNPSPAGIHICGYRLFIHPHSDKEMLMKRHLNTSYRLVWNHITGAFVVASELARARGKRAGVAVALSLAAATSLPALAADSVVPAGETVNGGTLINHDRQFVSGTADGMTVSTGLELGADSDNNTGGQQIARGGTARNTRVTANGLQDVMAGGSTSDTVISTGGGQNLRGKASGTVLNGGDQWIHAGGRASGTVINQDGYQTIKHGGLVTGTIVNTGAEGGPDSENVSTGQMVGGIAESTTINKNGRQVIWSSGIARDTLIYTGGDQTVHGEAHNTRLEGGNQYVHKYGLALNTVINEGGWQVVKAGGTAGNTTINQNGELRVHAGGEASDVTQNTGGALVTSTAATVTGTNRLGAFSVVEGKADNVVLENGGRLDVLSGHTATRTLVDDGGTLDVRNGGTATAVSMGNGGVLLADSGAAVSGTRSDGTAFRIGGGQADALMLEKGSSFTLNAGDTATDTTVNGGLFTARGGSLAGTTTLNNGATFTLAGKTVNNDTLTIREGDALLQGGALTGNGRVEKSGSGTLTVSNTTLTQKAVNLNEGTLTLNDSTVTTDIIAHRGTALKLTGSTVLNGAIDPTNVTLTSGATWNIPDNATVQSVVDDLSHAGQIHFTSARTGKFVPTTLQVKNLNGQNGTISLRVRPDMAQNNADRLVIDGGRATGKTILNLVNAGNSGTGLATTGKGIQVVEAINGATTEEGAFVQGNMLQAGAFNYTLNRDSDESWYLRSEERYRAEVPLYASMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYMNLTHTSSGLWADIVAQGTRHSMKASSDNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSINGSSAEGYNSQATLNVTF

SEQ ID NO: 138 - protein, 151 aa, Escherichia coli
MIHLFKTCMITAFILGLTWSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVFDPQDYHPLLITVSGKNVN

SEQ ID NO: 139 - protein, 302 aa, Escherichia coli
MPLPVLSLHRLSSPGRRVILVPESRLQGQIASAQALQHRFCHHPQCTVELNVGINAVNGPGMDTFSFCTATGNPAFQHILLDGLISTPQVLTVILPASWRQNVGGGDGLMFVTITVSQCRLCQRLACRWRQDQRLHGITLLLYPVKHAHHLVSPFNNFLHYVSPVWNTHFPQRLTTDAAVLADEPEVTRQHLVAGGTVMRVEQNNFRDMLSVYLSGPPQTQHVFGVSPAARVAHTGLAGEEWLKAFPLQAFQYGDGGDVRIVLASGRVFLFPENPRHMVHQLFMCQWTVTTYLVCSITKTTG

SEQ ID NO: 140 - protein, 44 aa, Escherichia coli
MESMSAEIFLITHPHVVFFFFCSYQSIKTHVNTLLSTQKYFVFF

SEQ ID NO: 141 - protein, 44 aa, Escherichia coli
MKKVLLIILLLLVGTGYRRWCGRLEGSPSCRQQIAYQRRDDIYP

SEQ ID NO: 142 - protein, 262 aa, Escherichia coli
MKKIMILLSLLMFLPLTAISKPLIPIMKTLFTDVTGTVPDAEEIAHKAELFRQQTGVAPFIVVLPDINNEASLRQNGKAMLAHAASSMSNVKGSVLLLFTTREPRLIMITNGQVESSMDDKHLGLLVENHTLAYLHADLWYQGINNALAVLQAQILKQPTPPLTYYPHPGQQHENDPPGSTTTLGLFAWAVAFIVFAAFFNYTTRLYYALKFAVAMAVANMGYQALCLYIDNSFAITRISPLWAGLIGVCTFIAALLWTSKR

SEQ ID NO: 143 - protein, 181 aa, Escherichia coli
MKLDIYYGAVLKSCRDFVIILVNNFIDRITVAWNFLFGCCCHTFLHCSVNTDCNINWLSGNKKNRQNKCKYWIHCAHPFGIRRKRASIETMHTLFNNSRSCFLLLMASSVNTGLLIVTPISKQPSDVLTFGNNVFIIAPSTMSFVMRCLVPPGDVNQLTINAGYRESTHNTVFGFNCSACA

SEQ ID NO: 144 - protein, 331 aa, Escherichia coli
MSGQPIATVMAVYIHLLVSASRNVTRGHIDVTTEDLASALDVTEEVIDSILQTMQGRVLDGDLITGWEKRQVLKEDNGNISQTAKSPAERKRAQRERERKREQNGDCHGASRNVTHMSRRVTTDKDTDTDQEDQNTMVHGVKNATNQAGDVQTVNLGQPAGTTPEADSAYALKADSGAVQQVMTARAEQSHQLQQPEADSAIQREADRVVPENTGQSVGRVDYPDVFEQVWREYPLRAGANPKKSAFSAWKARLREGVPPEAMLDGVRRYARYLAATGKTGTEFVQRATTFFGPDRNFENPWLLPVSGTNNQRCVNHISEPDNEIPPGFRG

SEQ ID NO: 145 - protein, 72 aa, Escherichia coli
MFKCNCTLIVGGIMKNALQFLFVAFWLFVSCMPIIFTARYMEKVDVLILIFGYINALFLGVFMAVMCIEYWR

SEQ ID NO: 146 - protein, 53 aa, Escherichia coli
MSKYGKQQICTLRSFFICDTFCFMLCVGIIFIKIFTDKINPPKRVKCGCIEDA

SEQ ID NO: 147 - protein, 59 aa, Escherichia coli
MTVVEAKGFFNLVSAPAVTLNYPFSLLFSAWWMLEPVRFECMKTPSAPAGKDGRIIRIV

SEQ ID NO: 148 - protein, 349 aa, Escherichia coli
MRVLLRPVLVPELGLVIVKPGRESMPVFHNTRLLVEPEPKSMRNLPSGVVPAARQPLVEDKTLLPFFSNARVIRAAGGAGALSDWLLRHIKSCQWPHGDYHHSETVIHRYGTGAMVLCWHCDNQLRDQTSESLEQLAHQNLSAWMIDVIGHAISGTQERELSLAELSWWAVRNQVADALPEAVLRRSLGLRAEKIRSMYRESDIVPGEQTATSILKQRTKNLTPLLHAHQQQNPPQEKTVVSIAVDPESPESFMKRPKRRRWVNEKYTRWVKTQPCACCGKPADDPHHLIGHGQGGMGTKSHDIFTLPLCREHHNELHADPLAFEEKHGSQVDLIFRFLDHAFATGVLG

SEQ ID NO: 149 - protein, 43 aa, Escherichia coli
MIAYCFCEWHCSSRIMSVLADGVLVAGVVVVAFPLLKKKTPDC

SEQ ID NO: 150 - protein, 111 aa, Escherichia coli
MKWIVIDTVIQPSCGISFSVIWSKIKLIIWYQSDAFLPPESIFTLTHTGIMLNNKVLPVTIYNVVPFNKTFWNLIKNSQECPTNTDNVLNECFNNRCTLQICPYGLKQQSP

SEQ ID NO: 151 - protein, 106 aa, Escherichia coli
MSVGRLRRLHELSEPSVVNWWLFYCCQLPDNGRRGMDQMEKITTGVSYTTSAVGTGYWFLQLLDRVSPSQWAAIGVLGSLLFGLLTYLTNLYFKIREDRRKAARGE

SEQ ID NO: 152 - protein, 160 aa, Escherichia coli
MGDRSVSRVAAIIYTLVICTIVCLSWAVNHYRDNAITYKAQRDKNVRELKLANAAITDMQMRQRDVAALDAKYTKELADAKAENDALLRKLDNGGRVLVKGKCPVPSSAETSSASGMGNDATVELSPVAGRNVLDIRDGIIRDQTALRTLQEYIRTQCLR

SEQ ID NO: 153 - protein, 50 aa, Escherichia coli
MPSMIAIILLIILHIWLCRQGGDHFWSKSRLNISLLMLDIEHLARSKGLR

SEQ ID NO: 154 - protein, 169 aa, Escherichia coli
MATQTEVARHLSLTDRQLRRLQKLPGAPISNKRGQLDLDAWRDFYISYLRRSKNDVPDGDSEDDYEEKLLIARWELTAEQAVTQQLKNEVSKGKLIDTGFCIFALSKLAMALSSTLDSIPLSMQRQFPDLTPRHLDHLKTLIAKGANQCARAGDKLPDLLDEYIRATTE

SEQ ID NO: 155 - protein, 123 aa, Escherichia coli
MLRQRRVTQGTAGKGVGLFVFIHTFRPADCLRRKGPRLVIRQHRLCAFKRQYQYANRTTGFLSVPDHQFPGGPIQHQGCQCRCCRGNPAAACGGVSRIITGKNTYFRTLFSDGFRHHIVKTSY

SEQ ID NO: 156 - protein, 131 aa, Escherichia coli
MKHTDIRAAVLDALEQHEHGATLFDGRPVVFDEEDFPAIAVYLTDAEYTGEELDADTWRATLHIEVFLPAQVPDSELDQWMESRIYPAMTAIPALAGLITTMVTQGYEYRRDDDMALWSSADLTYSITYEM

SEQ ID NO: 157 - protein, 853 aa, Escherichia coli
MSQPVGDLVIDLSLDAVRFDEQMSRVRRHFSGLDTDARKTASAVEQGLSRQALAAQKAGISVGQYKAAMRTLPAQFTDIATQLAGGQNPWLILLQQGGQVKDSFGGMIPMFRGLAGAITLPMVGVTSLAVATGALVYAWYQGDSTLSAFNKTLVLSGNQSGLTADRMLTLSRAGQAAGLTFNQASESLAAMVNAGVRGGEQFDAINQSVARFASASGVEVDKVAEAFGKLTTDPTSGLIAMAKQFHNVTAEQIAYVAQLQRSGDETGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQTQQDKNAQQQSDTEASRLKYTEEAQRAYERLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDETLEYKRQLAALGDKVTYQERLNALAQQADKFAQQQRAKRAAIDAKSRGLTDRQAEREATEQRLKEQYGDNPLALNNVMSEQKKTWAAEDLLRGNWMAGLRSGWSEWEESATDSMSQVKSAATQTFDGIAQNMAAMLTGSEQNWRSFTRSVLSMMTEILLKQAMVGIVGSIGSAIGGAFGGGASASTGTAIQAAAANFHFATGGFTGTGGKYEPAGIVHRGEFVFTKEATSRIGVGNLYRLMRGYAEGGYVGGAGSPAQMRRAEGINFNQNNHVVIQNDGPNGRAGPQLMKAVYEMARKGAQDELRLQLRDGGMLSGSGG

SEQ ID NO: 158 - protein, 204 aa, Escherichia coli
MQRFGRRLSLYVNTAAEAIRALSLQVPGFRRQMNEGWYQIRIAGDDTAPEAVYARLHEQLGEGTVIHIVPRLAGAGKGGLQIVLGAAAIVGSFFTAGASMVLWGTALSAGGFSATTMLFSLGASMILGGVAQMLAPKAKTPDYRATDNGRQNTYFSSLDNMIAQGNPMPVPYGEMLVGSRRISQDISTRDEGGGGKVVVIGRQG

SEQ ID NO: 159 - protein, 54 aa, Escherichia coli
MAAVAEFADAVCEAAAACALLAAFVSEVFAAFFDEAAAVSDFFAAAALCDDAPA

SEQ ID NO: 160 - protein, 97 aa, Escherichia coli
MDITSILHALCAVAVQVLAGLFTGNWAYGAIAGCTFFIAREHTQAEYRWIEMFGHGKRINMPWWGGFDPRAWDVASLMDFAVPVVACLLVWLLVNRG

SEQ ID NO: 161 - protein, 103 aa, Escherichia coli
MKYQVKRPLVECLTLRFPPSLRKAVFWAGVPLIFLSCVSLSLLSALLIILIPVITINYTINYTDRCTKGYNVKQAGTRKITNLFIIKNIVNNLKHYETAKNTN

SEQ ID NO: 162 - protein, 314 aa, Escherichia coli
MNYTVQKALKPVTVGDALTYWLESYVKENRVDYAALKKRLNNHVIQHIGAMPLDKCELRHWLACFDQVAKRTPVTAGFLLQTCKQALKFCRRRRYAISNVLDDMSVADVGKKPDISERVLSTKELGELLQALDKKIFSPYYVALIRLLIVFGCRTVELRLSEISEWDFTEMLWTVPKEHSKTKVAIFRPIPEAILPFVTQLVEQNRHTGLLLGEVKQETSVSQYGRLAHRRLKHPHWSLHDIRRTFTTMLNDLGVDPHVVEQLTGHQMPGMQRVYNHSRYLDAKRDALDMWTERLGILAGTHENVTTLPIAREI

SEQ ID NO: 163 - protein, 41 aa, Escherichia coli
MMQRHKILLLRLFYIFLRVIRQCIKKQYTYKNQMVITMADF

SEQ ID NO: 164 - protein, 428 aa, Escherichia coli
MNTGYSPEQGRGFVRPEKQNLQNFAEIIPVISGLTGGSETNIVNARALQMFDDKKGVNLTYTPDGNQNMSIISESGFYKLIKTKSAPLPERLCEQLTYCAKNESEQWDYINHVEKRHNCRITGKTKATRYGGPSTQATRYPQRMSIANNATFAAGGQCNQSGSVRCHTCNERFSLYSLRNCSRAKAHGANLSDSCSIFLRRLFRAGDNVLVNSLSVIVLSCIAMRRSYSHHGAGDGYSCSLALRRWRRLISPCIDAMMNCDVLSPDSFTDSMAFTISCGTRAFRACDFAFVVPVAISIPLLDWWGTVYTEKAQIKPLTWATPKAYSGPHLEIIKVHKCKAPQVSLPLAGLLTTNDSESIEVAMLNHTTHPQGRDSHNLNKYIWRFIALSTAQPRVITIEATSEQEARQQSPAGCVMVFAARIRQGVGL

SEQ ID NO: 165 - protein, 119 aa, Escherichia coli
MESKKKAALISSGIDESASAASSGTPENSCFRELKRSSRITPPIFTISNKNIFSVIQRPRCDVSDTFQGELCPVFLFFSLRKLCRAFNINKRVHQRSECGGGCVRCGFIAHVPLRIFFR

SEQ ID NO: 166 - protein, 584 aa, Escherichia coli
MKLAPNVKQQSRGIKHKETEVIIFAGSDAWSHAKQWQEHDARMAGDNEPPVWLGEQQLSELDKLQIVPEGRKSVRIFRAGYLAPVMIKAIGQKLAAAGVQDANFYPDGMHGQKVENWREYLARERQNLSDGLVIELPVKQKAQLSQMADSERAQLLADRFDGVCVHPESEIVHVWRGGVWCPVSTMELSREMVAIYSEHRATFSKRVINNAVEALKVIAEPMGEPSGDLLPFANGALDLKTGEFSPHTPENWITTHNGIEYTPPAPGENIRDNAPNFHKWLEHAAGKDPRKMMRICAALYMIMANRYDWQMFIEATGDGGSGKSTFTHIASLLAGKQNTVSAEMTSLDDAGGRAQVVGSRLIVLADQPKYTGEGTGIKKITGGDPVEINPKYEKRFTAVIRAVVLATNNNPMIFTERAGGVARRRVIFRFDNIVSEAEKDRELPEKIAAEIPVIIRRLLANFADPEKARALLIEQRDGDEALAIKQQTDPVIEFCQFLNFLEEARGLMMGGGGDSVKYTTRNSLYRVYLAFMAYAGRSKPLNVNDFGKAMKPAAKVYGHEYITRKVKGVTQTNAITTDDCDAFL

SEQ ID NO: 167 - protein, 53 aa, Escherichia coli
MHVICAHFRLTGSMSGFSVCFLRMSGSWKACFYIFHMVNLQRNRTWIPKNFHK

SEQ ID NO: 168 - protein, 47 aa, Escherichia coli
MFYDDVKSSPKPFPKTGYFLCCFDIYDNPVFTTIIIVSVGHFSGFMT

SEQ ID NO: 169 - protein, 296 aa, Escherichia coli; identical to SEQ ID NO: 11

SEQ ID NO: 170 - protein, 246 aa, Escherichia coli
MTTITKERIELFIKNPLENGLTRGEQMELARIALASLEREQIRHEHAKWSDSTFGCVGPIGPLKHLSKEALEAAAEPDDLSEWADMQFLLWDAQRRAGISDAEITVAMEDKLKINMERQWPEPKDGEPRLHIKEPGNSPVIPDGLSTVCAEAYQVVGVMADALGVFGDAAVQKVLDNLSQQKLVHRDVLPFSLPVTPDGWVMVPKQVTPEISNAINVVGQRCTCGNCSQRLWDLLLDATQQGVNRG

SEQ ID NO: 171 - protein, 50 aa, Escherichia coli
MDINTETEIKQKHSLTPFPVFLISLAFRGRYFHSHFQEFSHERLLHSGSS

SEQ ID NO: 172 - protein, 122 aa, Escherichia coli
MSNIKKYIIDYDWKASIEIEIDHDVMTEEKLHQINNFWSDSEYRLNKHGSVLNAVLIMLAQHALLIAISSDLNAYGVVCEFDWNDGNGQEGWPPMDGSEGIRITDIDTSGIFDSDDMTIKAA

SEQ ID NO: 173 - protein, 193 aa, Escherichia coli
MNNSWWQELMHFFLQGMTLKQLIHMLIILIILIIVMPVSVKEWINLHSPEILPHYWMYYILLFCVSYVLNGVVNSAYHAVTERIEVFAAQKRKSKEEKYVQDLFDSLTLGERAYLAFAVAANNQLQTEKGAHESISLLKKGLLVRRPPAVGYPDTDRFVIPESYRHECYIRFAGKADSLMDELIAQDKHGKNK

SEQ ID NO: 174 - protein, 126 aa, Escherichia coli
MPSSFILDLASSYHFIFMSLLLRSVLEPSMHNVYFYLYSQSTYCIFFIRVYYGGHMSNLRKYRESLNISQTTLAKAVGCTQGAIGHWESGRRFPDLKTCRALVACLNKLGAKVSLDDVFPPEHKAA

SEQ ID NO: 175 - protein, 296 aa, Escherichia coli; identical to SEQ ID NO: 11

SEQ ID NO: 176 - protein, 126 aa, Escherichia coli
MAVWNTGYIVRIRPVGIKMKRRLLLLFLLSVLAVGCSQQKADEPRQLVTVYPRYPEYAAANYIKGLVEVKFDIGADGTVTRIVFLRSEPHNLFRDEVVKAMAKWRFEKNRPCQGVKRQFIFTPSRP

SEQ ID NO: 177 - protein, 650 aa, Escherichia coli
MKTWAGGSMISDAQKAANAAGAIATGLLSLIIPVPLTTVQWANKHYYLPKESSYTPGRWETLPFQVGIMNCMGNDLIRTVNLIKSARVGYTKMLLGVEAYFIEHKSRNSLLFQPTDSAAEDFMKSHVEPTIRDVPALLELAPWFGRKHRDNTLTLKRFSSGVGFWCLGGAAAKNYREKSVDVVCYDELSSFEPDVEKEGSPTLLGDKRIEGSVWPKSIRGSTPKIKGSCQIEKAANESAHFMRFYVPCPHCGEEQYLKFGDDASPFGLKWEKNKPESVFYLCEHHGCVIHQSELDQSNGRWICENTGMWTRDGLMFFSARGDEIPPPRSITFHIWTAYSPFTTWVQIVYDWLDALKDPNGLKTFVNTTLGETWEEAVGEKLDHQVLMDKVVRYTAAVPARVVYLTAGIDSQRNRFEMYVWGWAPGEEAFLVDKIIIMGRPDEEETLLRVDAAINKKYRHADGTEMTISRVCWDIGGIDGEIVYQRSKKHGVFRVLPVKGASVYGKPVITMPKTRNQRGVYLCEVGTDTAKEILYARMKAEPTPADEATSYAIRFPDDPEIFSQTEAQQLVAEELVEKWEKGKMRLLWDNKKRRNEALDCLVYAYAALRVSVQRWQLDLAVLAKSREEETTRPTLKELAAKLSGGVNGYSR

SEQ ID NO: 178 - protein, 123 aa, Escherichia coli
MLRQRRVTQGTASKGVGLFVFIHTFRPVDCLRRKGSRLVIRQRRLCAFKRQYQYANRTTGFLSVPDHQFPGGFIQHQGRQCRCWRGNPAAACGGMSRIITGKNTYFRTVFSDGFRHHIVKTSY

SEQ ID NO: 179 - protein, 143 aa, Escherichia coli
MTVISATAASSPLPDTTGMLTLPAATPFTVMVIPLTDTVAFVLSADTARKLLSVAPSGWKATVSVVLCPFTTEELAGVTVIPVAAVTVLRSSAIDGRPTLVTFTVRVITSFAVTALPILLTQHGTHRPCRRESGFYRHGYHLH

SEQ ID NO: 180 - protein, 853 aa, Escherichia coli
MAEPVGDLVVDLSLDAARFDEQMARVRRHFSGTESDAKKTAAVVEQSLSRQALAAQKAGISVGQYKAAMRMLPAQFTDVATQLAGGQSPWLILLQQGGQVKDSFGGMIPMFRGLAGAITLPMVGATSLAVATGALAYAWYQGNSTLSDFNKTLVLSGNQSGLTADRMLVLSRAGQAAGLTFNQTSESLSALVKAGVSGEAQIASISQSVARFSSASGVEVDKVAEAFGKLTTDPTSGLTAMARQFHNVTAEQIAYVAQLQRSGDESGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQSQQDKNAQQQSDTEASRLKYTEEAQKAYERLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDETLEYKRQLAALGDKVTYQERLNALAQQADKFAQQQRAKRAAIDAKSRGLTDRQAEREATEQRLKEQYGDNPLALNNVMSEQKKTWAAEDLLRGNWMAGLKSGWSEWEESATDSMSQVKSAATQTFDGIAQNMAAMLTGSEQNWRSFTRSVLSMMTEILLKQAMVGIVGSIGSAIGGAVGGGASASGGTAIQAAAAKLHFATGGFTGTGGKYEPAGIVHRGEFVFTKEATSRIGVGNLYRLMRGYATGGYVGGTGSPAQMRRSEGIRFEQNNNVVIQNDGTNGLPGPQMMKAVYDMARKGARDEIQAQMRDGGLFSGGGR

SEQ ID NO: 181 - protein, 216 aa, Escherichia coli
MITALITAIGPGAGISQHDAPRKNGTIRFRRCGQYKGGTDRTQFAALLDAPAADHLLLRIGVAVSVDEVHRIQKTGVNLTPDHRSADQTLQIFHHPGDHTVQVRNRQRGARTGAFAIQFKTTPLNGIRLILSPLPGDRLTFFVLLITEKITFSTDLCQIDFPEHHAGRLLRTGAFIQCFLPDILHQFTTCSNSALNSTRSILTRDDHFAQVTFICL

SEQ ID NO: 182 - protein, 210 aa, Escherichia coli
MARICLYGDLQRFGRRIDLRVKTGAEAIRALATQLPVFRQKLSDGWYQVRIAGRDVSTSGLTAQLHETLPDGAVIHIVPRVAGAKSGGVFQIVLGAAAIAGSFFTAGATLAAWGAAIGAGGMTGILFSLGASMVLGGVAQMLAPKARTPRTQTTDNGKQNTYFSSLDNMVAQGNVLPVLYGEMRVGSRVVSQEISTADEGDGGQVVVIGR

SEQ ID NO: 183 - protein, 84 aa, Escherichia coli
MVATPAFSAADSALRREASSLSAEASSDARAFVSERSAAVAAFCAAVFEEAAAFALLPAFVSDVFAAFLDDAAAVSDFFAAAAL

SEQ ID NO: 184 - protein, 97 aa, Escherichia coli
MDISPLLHALCAVAAQILVGLFTGNWAYGAIAGCTFFIAREHTQAEYRWIEMFGHGKRMNMPWWGGFDPRAWDVASLMDFAVPVVACLLVWLLVNRG

SEQ ID NO: 185 - protein, 285 aa, Escherichia coli
MMALLLEPLQFTFMSHALLISLVVSIPCALLSVFLVLKGWALMGDAMSHAVFPGIVLAWILGLPLATGAFVAGVFCAVATGYLKDNSRIKQDTVMGIVFSGMFAAGLILYIAVKPDVHLDHILFGDMLGITIGDIIQTMIIAGLVTLVISVKWRDFLLFSFDYQQAQVSGLHTRWLHYGLLCMVSLTIVATLKAVGIILSISLLIAPGAIAVLLTQRFHIALLLATGISVIVSMTGVWLSFFIDSAPAPTIVVLFAVLFIMTFAVTSINARKKGNSHTQDLLSPN

SEQ ID NO: 186 - protein, 285 aa, Escherichia coli
MNVLLEPFSYEYMLNAMWVSAMVGGLCAFLSCYLMLKGWSLIGDALSHSIVPGVAGAYMLGLPFSLGAFFSGGLAAGSMLFLNQRTRLKEDAIIGLIFSSFFGLGLFMVSLNPTSVNIQTIVLGNILAIDPADILQLTIIGILSIIVLFFKWKDLMVTFFDENHARAIGLHPGRLKLIFFTLLSVSTVAALQTVGAFLVICLVVTPGATAWLLTDRFPRLLMIAVTIGSVTSFLGAWVSYFLDGATGGIIVVAQTLLFLLAFVFAPTHGLLANRRRAHKALEDRS

SEQ ID NO: 187 - protein, 285 aa, Escherichia coli
MHSIKKVTMLLGGLALTCSIAFQASATEKFKVITTFTIIADMAKNVAGDAAEVSSITKPGAEIHEYQPTPGDIKRAQGAQLILANGMNLELWFQRFYQHLNGVPEVIVSSGVTPVGITEGPYEGKPNPHAWMSPDNALIYVDNIRDALIKYDPANAQTYQRNADTYKAKITQTLAPLRKQITELPENQRWMVTSEGAFSYLARDLGLKELYLWPINADQQGTPQQVRKVVDIVKKNHIPAVFSESTISDKPARQVARETGAHYAVCSMSIPEHRKRPGTDVYRPS

SEQ ID NO: 188 - protein, 75 aa, Escherichia coli
MALIHSLKNTLVNQPIAVVLLIVLIYASFFRTLIVTASSDLFKYPVLRRVYFFTTPGFLNFPFFAASLKNRYPLS

SEQ ID NO: 189 - protein, 663 aa, Escherichia coli
MLNGIYSMRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQNNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 190 - protein, 252 aa, Escherichia coli
MTLLAVRHASLGYSRHPVLRDVSFTLSQGTICCLLGANGCGKTTLMRSILGVIPLLKGEILLDSLPVQTLSHRQRAQAIAWVPQAHDGIFAFSVLDMVLMGLAPTIGAFSVPGKQERLKATEQLEKLGILHLATRRWNTLSGGERQLALIARALVQQPRLLLLDEPASSLDFGHQIQLLDTLAQLKNNGMTMLMSTHHPLHANAIADSIIQVEPDGRVTQGLPTEQLTTKKLAALYRVSADQIHHHLSAIKH

SEQ ID NO: 191 - protein, 298 aa, Escherichia coli
MQQLLALILRQENVPVQEQIVFWQIRVPRILAALFLGAALAGAGTTYQGMFRNPLVSPDILGVSAGAGLGACAAILCGLSIVYIQLYAFCGGLMVVAGVWLITRRVTRHAPILTLVLVGIALGTLCGAGISLIKTLADPYTQLPSITFWLLGGLSTVTLRDLCYAAPIILIGSLPLFFLRWRMNLLTLSDDEARSLGLNVTRLRFGLIVCATLITASTVAIAGIIGWVGLVVPHIARLLTGHNHQQLLPMAMCTGAILLLLTDTLARSIGTTEIPLGILTAFVGAPFFLFLLLRGGRQ

SEQ ID NO: 192 - protein, 340 aa, Escherichia coli
MSLTRRRFTQILASTLFLHHLPSFAQSVKFWASLTLPEAQNITRIVSAGAPADLLLLAVAPEKMVGFSSFDFARQALIPLPEHIRQFPRLGRLAGRASTLSLEGLMALHPDLVVDCGNTDETWISQARQVSEQTQIPWLLLNGKLEQSAEQLTTLGKTLGEEHRAAEQANLASRFVGEAQAFATSPAANLSFYAARGPRGLETGLQGSLHTEAAELLGLHNVAQIADRHGLTQVSMENLLRWQPDIILVQEAVTADFIRRDPLWQGVKAVAEQRILFLSGLPFGWLDAPPGINRLLGLRRLHAWLDPAINRQFKSDMQHYAQLFWHCSLSDADYQKLVAS

SEQ ID NO: 193 - protein, 41 aa, Escherichia coli
MLIITPLFIFFATPPFSLTIFLWNKVLFKQQANHSVSLDKF

SEQ ID NO: 194 - protein, 76 aa, Escherichia coli
MQLLCDNNHSALTVQEFVMKKTFTFSLLAIVFASLLSACVPHHHHRHSDGPRGPAPSGKPMPPSNGGPNHGSHGRY

SEQ ID NO: 195 - protein, 92 aa, Escherichia coli
MRRNVVGALSLAALVAGKRKPPHVERSNLTTERGLILNHQQFKNSRKMLSLQQKGGYMTLAQFAVIFWHDLAAPILAGIITAAIVGWWRSRK

SEQ ID NO: 196 - protein, 347 aa, Escherichia coli
MVHLWSSEGALTVARPNQPTISAALKIIATGIALPPDQITSQQLDVQLNKPVGYVERRSGICWRYFARNDASQAELAAEALHNALVAAALNPTDIDLLICASAIAVQALPCSAIHILKAAAMPAGVAGFDINSSCVSFISALEVGAGLLNCGAYRRIAIVSADIASRGIDWDHEESSLIFGDGAACAIVERGDGRSGIIASLIEMYPEGSELCEIRAGGTRRNPRSGVSDSDFLFHMQGKPLFRFASSLIEDYFSRLLQKSSLQLDDIGTVVPHQASHLSLEHMRKRLRVPESALIDVYRFYGNQVAASIPTALHEAVISGRFTADKPVMLIGTAAGLTLAGMVLLP

SEQ ID NO: 197 - protein, 428 aa, Escherichia coli
MIPLALLWRYFRTRKLHFTDREALENWQAKRLHQFRQNVLSHSPWFQRYLTLPFNQWPMMDKALMMTHFDEMNTAGLKRDELLDCAMRSEQSRDFKPCVGRFSVGLSSGTSGRRGLFVVSPHEQQMWAAGVLAKVLPDGLFAKERVALFLRADNNLYQSVNNRWLSLDFYDLLAPFQAQLKLLQQRAPTIIVAPAQVLRALALEVMAGELTLKVKKVISVAEVLEPQDRELLRNVFHNVGEIYQATEGFLASTCRCGTLHLNEEFVHIEPQWLDEHRFVPIVTDFTRTTQPIVRYRLDDVLVASEQPCSCGSATMAIARIEGRQDDQLQLPTRSGDIQTVFADACSRVLAMTLPLTVDYRLLQTGSAQLTLIADCELWMLEHCREALNALFIRQDIAVGQLIWSLEPQTVPVSFTAKRRRIVRQWGRE

SEQ ID NO: 198 - protein, 204 aa, Escherichia coli
MGAGMSNSLLRLKQMLLGWGTVGVIYNFSDYLQGEGYQLTPSIIDNWISFSPSAVWLYLSFFFIVPLGYLSTPLCHLRWLARSMQISALVAGVFYLLWPTTMHYPSFDQMGISAGALNRLIAIDSSQNCFPSLHAALTLLAVWAIAKKGNRWLTLMSVVWAIAIAFSILQLRRHLFIDLVGGALLASICGWICATCEKRKTQYE

SEQ ID NO: 199 - protein, 374 aa, Escherichia coli
MSDLLFPIISMVLLVLAEAGVLQFTGRQKVDWLDVIFNINSGHMMLWLFRCLEVLCYGLVINHFSLGLFDNAPVILLWLFTILAWDFGFYWLHRWHHEMRPLWAVHVVHHQGEHYNLSLGVRNSWYSSLTSIPFFMLLAMLGVPLQIFLAVSIIHYSWQFFNHNALTPKLGWLEKVLITPSHHRVHHLNQKQYADTNYGGTFLLWDKLFGSYSAGPEYDVGYGVKNSRLSCNPMRESNLPFLRLMGFRSFGKAIEGRYQSSPWAVGAGVILLFMLVLGYIQQYGYGIEFITSEQAVLFVLLAAGSVALGGMSDGQHWGMILWCSVTLSLLYFIVYMCSWSTLLWKGLVGILLAHCLLFVIGVGRKSLRKQYEPV

SEQ ID NO: 200 - protein, 363 aa, Escherichia coli
MNLFNPDRLITFPADDPQLVKQLQSGTKVYLAKSGDHRYADGWAFAKMAALIIACLCCYALALSQSLWGLYLLWYLAMMFCAMLLAVNVVHDASHDAFLRGKKTNARLNRWVAFPMGLDPDCWRVRHVRFHHGFTNIEFYDPDTAENGILRQTPWQRWRPFMRQQHHYWPLVAALTFPWYIWVVDWLDRAGFTPVTRHLALRGFAGWGYFLAGKLAHCALCLILPWLLSDFSFMTILLTYLLSQLLASLIFVTLIIGTHWAKGHTQLPPEEGKMPVGRLAHTFVTTFDWTPQPAWLGYWLGGINLHLTHHLFPHWHHRHYPALSRIIAQIASQQGLDYQLLTLADLLRLQQQFLRRMGEKPKA

SEQ ID NO: 201 - protein, 384 aa, Escherichia coli
MRRVFLTLEKIMKYIATSVVAMLLLSGCDNTQSNNSSPSETEVGVVTLKSQPVSVVSELTGRTSAALSAEVRPQVGGIIQKRLFKEGDLVKAGQPLYQIDAASYQAAWNEARAALQQAQALVKADCQKAQRYTRLVKENGVSQQDADDAQSTCAQDKASVEAKKAALETARINLDWTTVTAPISGRIGISSVTPGALVTASQDTALTTIRGLDTMYVDLTRSSVDLLRLRKQSLATNSDTMSVSLILEDGTTYSEKGRLELTEVAVDESTGSVTLRAIFPNPQQQLLPGMFVRARVDEGVMEDAILAPQQGVTRDAKGNATALVVNKDNKVEQRTLETGETYGDKWLVLNGLHNGDRLIVEGSAKVTSGQTVKAVEVQANGGNA

SEQ ID NO: 202 - protein, 47 aa, Escherichia coli
MKFRLMEATPDVFALFCSPPGLCLGYRHFDYVGGDSGYSHIARRAIS

SEQ ID NO: 203 - protein, 1005 aa, Escherichia coli
MPVAQYPDVAPPTIKISATYTGASAETLENSVTQVIEQQLTGLDNLLYFSSTSSSDGSVSINVTFEQGTDPDTAQVQVQNKIQQAESRLPSEVQQTGVTVEKSQSNFLLIAAVYDTTDKASSSDIADWLVSNVQDPLARVEGVGSLQVFGAEYAMRIWLDPAKLASYSLMPSDVQSAIEAQNVQVTAGKIGALPSPNTQQLTATVRAQSRLQTVDQFKNIIVKSQSDGAVVRIKDVARVEMGSEDYTAIGKLNGHPSAGVAVMLSPGANALNTATLVKDKIAEFQRNMPQGYDIAYPKDSTEFIKISVEDVIQTLFEAIVLVVCVMYLFLQNLRATLIPALAVPVVLLGTFGVLALFGYSINTLTLFAMVLAIGLLVDDAIVVVENVERIMRDEGLPAREATEKSMGEISGALVAIALVLSAVFLPMAFFGGSTGVIYRQFSITIISAMLLSVVVALTLTPALCGSVLQHVPPHKKGFFGAFNRFYRRTEDKYQRGVIYVLRRAARTMGLYVVLGGGMALMMWKLPGSFLPTEDQGEIMVQYTLPAGATAARTAEVNRQIVDWFLINEKANTDVIFTVDGFSFSGSGQNTGMAFVSLKNWSQRKGAENTAQAIALRATKELGTIRDATVFAMTPPAVDGLGQSNGFTFELLANGGTDRETLLQMRNQLIEKANQSPELHSVRANDLPQMPQLQVDIDSNKAVSLGLSLNDVTDTLSSAWGGTYVNDFIDRGRVKKVYIQGDSEFRSAPSDLGKWFVRGSDNAMTPFSAFATTRWLYGPERLVRYNGSAAYEIQGENATGFSSGDAMTKMEELANSLPAGTTWAWSGLSLQEKLASGQALSLYAVSILVVFLCLAALYESWSVPFSVILVIPLGLLGAALAAWMRDLNNDVYFQVALLTTIGLSSKNAILIVEFAEAAVAEGYSLSRAALRAAQTRLRPIIMTSLAFIAGVMPLAIATGAGANSRIAIGTGIIGGTLTATLLAIFFVPLFFVLVKRLFAGKPRRQE

SEQ ID NO: 204 - protein, 457 aa, Escherichia coli
MLRRSLIFLVLLSAGCVSLDPHYSTPESPIPATLPGAQGQGKAISHDWQQVIHDPRLQQVVTIALNRNRDVQKAIADIDSARALYGQTNASLFPTVNAALSSTRSRSLANGTGTTAEADGTVSSYTLDLFGRNQSLSRAARETWLASEFTAQNTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKNVQSAFKDVANALARRTTLEEQLDAQRQYVKAEQQTVDVGLRRYQAGVGDYLTVLTAQRSLWSAQQELLALQLTDFTNRITLWQSLGGGMSSLK

SEQ ID NO: 205 - protein, 387 aa, Escherichia coli
MARVSLSWALILGLLAGIGPMCTDLYLPALPEMSEQLAATTTITQLTLTASLIGLGVGQLLFGPLSDKIGRKRPLILSLLLFIVSSILCATTNNIYWLVVWRFIQGIAGAGGSVLSRSIARDKYQGVTLTQFFALLMTVNGLAPVLSPVLGGYIVSTFDWRTLFWVMAEISTVLLLGCLLFINETLPENKRGSSLLLTGRSVVQNRRFMRFCLIQSFMLAGLFAYIGSSSFVLQKEFGFSPMQFSLVFGLNGIGLIIASWIFSRLARRINAMTLLRGGLIAAILCALLTVLCAWIQLPIPALVALFFTIAFCSGIGTVGGAEAMSAVGTQESGTASALMGMSMFVFGGIAAPLSGIGGETLLKMSLAITVCYTLALLVALTRIDNQK

SEQ ID NO: 206 - protein, 66 aa, Escherichia coli
MKCSFLFNPHNLPGMQCYFITQYINFTNQIPTVQVSNIYMLNIFTDIKQSRQAIAIRIASLNSHYK

SEQ ID NO: 207 - protein, 63 aa, Escherichia coli
MPSFLQAEKSKNRFMLKYCDKPDAKPGTYFLLVLIFLVVWLLMLLAWYLVGLPTGPGIYPRLS

SEQ ID NO: 208 - protein, 102 aa, Escherichia coli
MMIISKKQLIGVVAIGILLAGVVFFIWWVSKGRFIQTTDDAYIGGNITTVASKVSGYISAIEVRDNQSVKKGDIILRLDDRDYRANVARLEGFRSSLRWPPS

SEQ ID NO: 209 - protein, 132 aa, Escherichia coli
MAPIVTLTLGGIPKERLKLASGVFNLTRNLGGAIGIALCGSILNNRTNFHFSRMGEKMVSVPHMVNDFISRSALFFNRSGSDQTSEILASTKLLSQLMLREAQTMAFSDTFLLISGLLFIAFLLVPAMNKSS

SEQ ID NO: 210 - protein, 122 aa, Escherichia coli
MNYALIIAIIISFPCALLSVFLVLKGWALIGDAMNHAMFPGIVLAWIIGMPLGIGAFIVGLSCAITTGYLKDNSIIKKDTIIGIVFSGIFVLTINRHKSADYRYHYYITVYSAWYRLPFLPH

SEQ ID NO: 211 - protein, 74 aa, Escherichia coli
MVHQFRRRRYHNAQHQRKFGIYQDVVDECPTHLFDYRLDISEIPSITVRINESIAFSLIIQPQILALNICTPCH

SEQ ID NO: 212 - protein, 78 aa, Escherichia coli
MLGSVLASAWRAGSLRLVSVNALFVAPAQAFTVPEVGKRQLNEINRIRYELELMAVALAVENLTMQKNVALLCQQYSR

SEQ ID NO: 213 - protein, 347 aa, Escherichia coli
MNQIKDNKVIMKIKNLISVILLSGGIMGTGLYSSDNHQKIRSRFNIQESYCAIKTNGVLGFSNRKDVLRENGDSTGTTSSSTNAMMLMENGENEISLEIGALRWFSDKPASTEERGHFSQKAGCSLDLVRFVKQEETILSSIKVTINQQGIPEAQPDSMHPVIRKEILAEQAEPGFIDPDYFNETYFPKGMKVYQFTQKVSVAGLPEWAWTRATPFTGSDEQLQKLKAAYIEMAAIISSGDRARLKASHKEALKAWSVTTGDSEDEILLSLYPKEEIEGRKARMQPIRWGDYAIRVMNNGRMVQLYNKSKPTYSPLTYRFIDEDGDEVMGYYAPVFSLIDGQFIPVT

SEQ ID NO: 214 - protein, 94 aa, Escherichia coli
MPLAARLNDKGTQHDGYRETVIIAASSTVFIDGLPAARQGDPLTPHDKPKHPPHPRKIARGSSTVFIDGLPAARTGDAIDCGGVVIGGGTVNIG

SEQ ID NO: 215 - protein, 168 aa, Escherichia coli
MFKTMGFRKTIITSVGLIFISFSFVAKCSQLKNLNNYSVMLCGKVSNNILDDIGGYKERNILMLRAIKKIIIMTIVNIIFFYSFQSTADEMVLIKKYGFGLERDIKGRPLIYPIENYDECKKKCNHMNYIADVNAQLAMSKKNNRIFANITFTNNSSTTYFFLNIIYL

SEQ ID NO: 216 - protein, 226 aa, Escherichia coli
MIQYLNVFFYDIYPYLCGTVFILGSWLRYDYGQYTWRAASSQMLDKRGMVIWSNLFHIGILGIFFGHLFGMLTPHWMYAWFLPVAVKQQMAMILGGICGVLTLIGGAGLLVRRLTNPRIRVTSSGADILILAILLIQCILGLTTIPFSAQHPDGSEMMKLVGWAQSIVTFQGGASTHLDGVAFIFRVHLVLGMTIFLLFPFTRLVHVWSAPFEYFTRRYQIVRSRR

SEQ ID NO: 217 - protein, 314 aa, Escherichia coli
MVRTIIFDLLMISLLVIVHFLIRANTDVVENQPGKSGNKASRCQRFQRAFPQAYRGIDLRIFRQTMIQLRLIGMMQHVHNVRTTDPFRVVDASMFVTTRFQFRYALFRQLQHLLLGAEVDSPGRTGFHTSRFLADADAIDAEGAFIYPVILFVEARNIKRTTGNAVTTADAIFRLEIDNPVSVLNDCTSRRARLQAARIFTVHTAVFTDQPLQLAVLFGFAKAHHRPGLGAQIGGVIVNPDAVPHFITDVVPLRTRHLTGFTADTGGNVDKFRYFCFVITHLRRRRDGVSCGPFDNVLRFHSHLFAPLRLLDVD

SEQ ID NO: 218 - protein, 46 aa, Escherichia coli
MIDIDAISLELYISGYLLWKFNLSAGIIFSPDFIRIILLILVLFLT

SEQ ID NO: 219 - protein, 883 aa, Escherichia coli
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 220 - protein, 236 aa, Escherichia coli
MQTTRTPYSVSFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 221 - protein, 203 aa, Escherichia coli
MLTLFIQLLKYKFWRIMKLKHVGIIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDSTGEVLVLDGATFSAKTDLIDGTNILPFQARYIALGQSVAGTANADATFKVQYL

SEQ ID NO: 222 - protein, 315 aa, Escherichia coli
MRFEGNASTRKSSMLKENFNELQIFLVVARERSFTKAASKLGVSQSALSHAMKALEERLNIRLLTRTTRSVAPTEAGERIIACLEPRIDELERELESLIQLNGAPSGNIRLSAGEHAARSLVWPKLKSFLREYPEINVELVVDNGFVDIVDGRFDAGIRLGESVDKDMIAVRIGPDMRMAMVGSPAYFAANPAPETPHELQNHRCINNVTWINLRIVLKISTVWLISSASILVLIAPVLVCWGFAGEEGIHLLPPRRTNDSNRLQPLACLIQDLYGAMVCRIHSWILFNNVLSRLQMHELRKSPVAKCFTPVMPT

SEQ ID NO: 223 - protein, 557 aa, Escherichia coli
MNIKTLNVSLLSISIITALFPLNAMATKLTIEQRLELLENELSQNKQELKATQNELGVYKFRLSTLQKSITENKYQSASLAEISATSPVADNIKNENGEQNSSAAAHTINGSQQIAVIESKGDKTTIESVTLKDISKYIKDDIGFSYQGYFRSGWGTGNHGSPQTYAAGSLGRFGNEMSGWFDLTLNQRVYNQDGRTANAVVTYDGNVGQQYNDAWFGDSANENIMQFSDIYLTTRGFLPFAREADFWVGKHKLPQYEIQMLDWKTLTTDVAAGVGIENWALGVGLFDMSLSRDDVDVYSRDFTRTSQMNTNSVDVRYRNIPLWDDATLSLMAKYSAPNKTDQQQDNENDDSYFEMKDSWMLTSVLRQNLQRDTFNEFTLQVANNSYASSFASFSDASNTMAHGRYYYGDHTNGIAWRLISQGEMYLTDNIIMANALVYSHGEDVYSYESGAHSDFDSIRTVIRPAWIWNTWNQTGLELGWFKQQNKTQQGVTLNESAYKTTLWHALKVGESILGSRPEIRFYGTYINILDNELSNFKFNENSKNEFMAGIQVEVWW

SEQ ID NO: 224 - protein, 453 aa, Escherichia coli
MGCINIQDNRYKKMGLMASFERGMERFLVPVAIKLNSQKHVAAVRDGFVFTFPIIMASSLIILINFAILSPDGFIAGLLHLNSIFPNLEKAQAIFTPVMNGSVNIMSIMIAFLVARNVAISYEQDDLLCGLTAIGAFFIVYTPYQMIDGQAFLTTKYLGAQGLFVAVIVALITSEIFCRLARNPKITITMPAAVPPAVARSFKVLLPIFFVMVFFSALNYCLTLISPAGLNDLIYTLIQTPLKHMGTNIFAVIILGAVGNFLWVLGIHGPNTTSAIRETVFSEANLENLSWAAQHGTTWGAPYPITWTSINDAFANCGGSGMTLGLLLAIFIASKRAEYRDLAKMSFIPGIFNINEPIMFGLPIVLNPIMMVPFIMVPIVNCAIGYFFVSMEIIPPVAYAVPWTTPGPLIAFLGTGGNWLALLVGFLCLGVATMIYLPFVIAANKVNNMTTNG

SEQ ID NO: 225 - protein, 103 aa, Escherichia coli
MKKILLVCAAGMSTSMLVKRMIDHATAISLEVNISALAIAEAKGKIKNNEVDVVLLGPQVRFQKPEIEAVAQGKMPVAVIEMKDYGTMNGQAVLEFAMKLLQE

SEQ ID NO: 226 - protein, 40 aa, Escherichia coli
MMVAPVRLMALAYLHVICALIAADKGATLLVFRHRSSYSS

SEQ ID NO: 227 - protein, 121 aa, Escherichia coli
MLLRNLPQAVEKISHNCYTTALFIINFATSPIHAENTLITLHYKKEIISLFLETTPIKANHLRSILDYIEQEQLTAEKRNHCMKLSKKIHREKTIQPTVNLNDSAFFCNLLLTLFFVAICH

SEQ ID NO: 228 - protein, 266 aa, Escherichia coli
MKKTFMGIIVLSSLSHFAAAESYTEKFYRKLTTAELSWAQKQEALKEVNCSEYLIKKTITTIDGFTILSEDMLFTKRPIFPQGKIVCSISPYNEENKEFSFSSEEQGTVDGVAYHLSHGRVVAGYIGDGLFSWEMECENRKSKNNDSSAKFCYVKDLQFYVQYIPELKEINVPKGYVISHGETHFSAITRFMVDKQEISINSKLPFIYGESAKEVFKIIKPTSTISYVAVNPLNNKESDYEVSGKMIEQLPAALKILERTWSLYKN

SEQ ID NO: 229 - protein, 48 aa, Escherichia coli
MPGHWCGLLKVDYCNFPAATAAAEILLPMLTSLLAALPAAYVSRHPGQ

SEQ ID NO: 230 - protein, 375 aa, Escherichia coli
MCFFWITALIDIFMKIIITREYIMKRKVLAMLVPALLVAGAANAAEIYNKNGNKVELYGKMVGERILTDRENGEKGDNSQDTSYARVGVKGETQINPELTGYGQFELDLEASNRHNPDQTRLAYAGLSYKDFGSFDYGRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSKALDVAGYKDSDRLNYIEIGTWYYFNKNMNVYTAYQINLLDKSDYVLAHGLNTDDQLAVGIVYQF

SEQ ID NO: 231 - protein, 74 aa, Escherichia coli
MLCNIRVKMKVQATTKQMAMAMVYLQLTLLTVSHLLVLMQTLTVLIGSLVMVKAKEPKFGRCQQNMTLTMSMLL

SEQ ID NO: 232 - protein, 487 aa, Escherichia coli
MIKKKGFTLLEVTIVLGIGTLIAFMKFQDMRNDQEAVLADNVGTQIKQLGEAVNRYISIRYDKISTLSSSNNQSSDPGPRTCSAAGCEITYQTLINEGLLPVGYTGTNAQKASYKIVLKRSGTAPDYVINGLITTASPWEEGGRIRYDLLGKAVQAAGVDGGMSRNTKIASGYGGQWSENSNSYSNITGGGLLAYRVGYNSSMYSVYLRRDGTLPMTGDLNLGGKSIKNIKDMTASGTTTTGALKTTGNASVASDLSVGGTSTLNGPVNINNNLKVKSDTYLNTLSTTGLAKFGSRIATNGLNPNDLPAGWAGGVRTYDLYASGTVGVGTGKTVKAYMNNAGNIYASGNLTAGTIKSNGTIESTGRIKAGEYLHLNGQATLNAKCTPNGLVGRDSTGRVLSCVSGKWQTASGDGLKGIFITITDQTSGYKCVIPNSDTGACACPGSMYDSRYGFLSGTLIAEYDERRCSGSKNEHCYSNFRRLYACK

SEQ ID NO: 233 - protein, 185 aa, Escherichia coli
MVLLNNKRKSKKGFSLLELLLVLGIIAALVVAAFIVYPKVQASQRAQAESNNIATIQAGVKALYTSASSFTGLTNTVAVQAKIFPDNMLSGSGTAAKPINAFKGNVTLAATATGPSSATGSSFTITYDNVPAAECVKIATAAAGNFYITTVGTKVVKAAGGTLDVAATAAACTNATSNTLVFTSI

SEQ ID NO: 234 - protein, 307 aa, Escherichia coli
MIAYENIEFFICLVNVLGNNMYNILFFIFLSIAIPFLLFLAWKQHLKTKEIRSYLLKEGYNIIFNGEGNSYLAFNISNATFRAGNLTSNDYFQASISYIHDYRWEWKEVEAKKINNIFIIYISNIDFPSQKLFYRNNKSLAEIDWAKLQAIFHQPYEIQNDVMQDNNNTHYDFFISHAKEDKDTFVRPLVDELNRLGVIIWYDEQTLEVGDSLRRNIDLGLRKANYGIVILSHNFLNKKWTQYELDSLINRAVYDDNKIILPIWHNINAQEVSKYSHYLADKMALQTSLYSVKEIARELAEIAYRRR

SEQ ID NO: 235 - protein, 278 aa, Escherichia coli
MAKVNFFDKRILKKFSDYTSTISTIFSLFLIFVDIPTENKLTLGIIFLIILFLLYFGIWFKSNNLSEINLDVEGSIVTVKAGDLFRQDGFKVIAFNEYFDTQVDDVIISHNSLNGLYIDNYLAGSVSDLDHRISNHQFEEDELLEVNHKRKVGKTQKYSLGTIFVNNDYLLTAFSKFDDKNRAFLTMPDYLAFLINFWDKVNRIYAQKSVSVPIFGSGITRIKEHKNISDEDLLKIMLWTFRISEMRFKFPAKLTIVIHKDKIDKINLLDIKSARNGL

SEQ ID NO: 236 - protein, 191 aa, Escherichia coli
MVKNLGTLIIRMDKQMKKILLVAGAALALAGCGEKGDFEKAINAKIGQDKYCFSLDNNNTSFPIRLAKPRLDSTGTGTNSVILDGFVEQGMMVFEQGYDSNVLGITEEGKKAKVWSTTDGACVGRRAVDGIKEWTEPGNGNQKVVRVTYTWKLVDVPGWIDKKAFASVKGMNEPADGAMNLFKTSNGWKAN

SEQ ID NO: 237 - protein, 162 aa, Escherichia coli
MEEVRLEAVGIVFLVVLFIIIMTAVDIQKKKHYNSFTEVLDGDILSYECQQTGIVIDTQKHTVRIFNKDKDSTYTFDQIREINYTLSEGGKFYGNGTLRGMNNAAIANWREQLSANKRSGLNILTDDIKNPMWKVNVPLKNLSTSNHELCERWMLVFKKYVF

SEQ ID NO: 238 - protein, 70 aa, Escherichia coli
MFSESHLSSISGTKMKKLLLAIFIILPLGGCTVHGNKSLTDENHQTVKVKIVKGKTTQQEILAAFGERYE

SEQ ID NO: 239 - protein, 320 aa, Escherichia coli
MEGKLIFCSDAILRFQSDYDETSAVPLLSIQNTIANTDPFFLLRFFHHTVLIEEGTSLASIFLAIELWKALLAAYLDRDVGAYIDEVRKPSGPTTWDIEWIGIDRRSSVYRAYKRQDMEEGEDFSTYFNRERFPTDEFDIESSCDASGFIKGDKERWSISGDVHEIKNLPVILYSKQALMTSAKDGLLKKNVSGVKSSKHGCFVYGDTSFSFSEVMEAIFISGLFFYAPIDAASSLDELKVSLAGLEEELAEVPKVDSNGNETDKEPTIVVAEGAFDSVAAHMETEAEEWQSIKNLCQREGELPIRIGGIKMAEPPEFHF

SEQ ID NO: 240 - protein, 50 aa, Escherichia coli
MSFSMSEFYSMFSIFYFVYNTDHKWCFLIGMKECYHFNIFHFIFYFFITI

SEQ ID NO: 241 - protein, 126 aa, Escherichia coli
MSKGGSGRNLMGFEAKKKHAIAIMESKRMWRSNYAPPLLHLAWKAGLKIPPLPFASFWQITLLMGGWFGPAWGICMWFFTWKDTGIQPGTAFVSSVVAGICFGVLMAAYHWWRKVVNNLPDWDSLG

SEQ ID NO: 242 - protein, 467 aa, Escherichia coli
MSRVLMRNCSHIMGVIRRCGRRKWPRACGATTGVPRLESGCMSDVQSNVKPLTLTTGRVIFAIAGVYVTQSLVSALSMQSLPALVRAAGGSLALAGATTLFMLPWALKFIWAPWIERWRLPPGSQERRSRMLILRGQVALAAILTIAAAIGWFGREGGFPDTQIVALFVLFMVAGTVASTIDIASDGFCVDQLTRTGYGWGNSVQVGGSYLGMMCGGGVFLMLSAASGWPVAMLMMAVLIMALSLPLWRITEPTRTATIPHVPALGYALRRKQARLGLLLVLMLNSGMRFVLPLLAPLLLDHGLSMSALGALFSGGNIAAGIAGTLAGGLLMKYTSPGRALLTAYGVQGIALLAVVMTLMMAPGHLLLQILQCLVIVQSISLACALVCLYATLMSLSSPLQAGVDFTLFQCTDAAIAILAGVIGGVVAQHFGYAACFLFAGAFTLLAAWVAYIRLHSARELMTSAID

SEQ ID NO: 243 - protein, 609 aa, Escherichia coli
MEHRKRWWKMKDNNPADNLAWRVIWRQLISSVGSQARMLRRSMLALLLAAFMQGIAFACLYPIIDALLRGDAPQLLNWAMAFSVAAIVTLVLRWYGLGFEYRGHLAQATHELRLRLGEQLRRVPLEKLQRGRAGEMNALLLGSVDENLNYVIAIANILLLTIVTPLTASLATLWIDWRLGLVMLLIFPLLVPFYYWRRPAMRRQMQTLGEAHQRLSGDIVEFAQGMMVLRTCGSDADKSRALLAHFNALENLQTRTHRQGAGATMLIASVVELGLQVVVLSGIVWVVTGTLNLAFLIAAVAMIMRFAEPMAMFISYTSVVELIASALQRIEQFMAIAPLPVAEQSEMPERYDIRFDNVSYRYEEGDGHALNHVSLTFPAASMSALVGASGAGKTTVTKLLMRYADPQQGQISIGGVDIRRLTPEQLNSLISVVFQDVWLFDDTLLANIRIARPQATRQEVEEAARAAQCLEFISRLPQGWLTPMGEMGGQLSGGERQRISIARALLKNAPVVILDEPTAALDIESELAVQKAIDNLVYNRTVIIIAHRLSTIAGAGNILVMEEGQVVEQGTHAQLLSHHGRYQALWQAQMAARVWRDDGGSASGEWVHE

SEQ ID NO: 244 - protein, 600 aa, Escherichia coli
MSSQSSNTESLSRFPLWQVITPVRRKVILAMALAGLAALTSLGALLFLAWSLRDIRATPDAIPAWPLGGVIGCVVLTFVLRLQAFNTSHYAAFHLENILRSRLARKALQLPPGVLQQMGSGSVAKVMLDDVKSLHIFVADSTPLYARAIIMPLATIVILFWLDWRLAIATLGVLAFGSVVLVLARQRSEDMAQRYHKAREQVSAAVIEFVQAMPVVRTFDSGSTSFLRYQRALEEWVDVLKTWYRKAGFSARFSFSILNPLPTLFVLIWSGYGLLHYGSFDFIAWVAVLLLGSGMAEAVMPMMMLNNLVAQTRLSIQRIYQVLAMPELSLPQSDQQPQEASITFEQVSFHYPQARTGAALQEVSFHVPAGQIVALVGPSGAGKSTVARLLLRYADPDKGHIRIGGVDLRDMQTDTLMKQLSFVFQDNFLFADTIANNIRLGAPDTPLEAVIAAARVAQAHDFISALPEGYNTRVGERGVFLSGGQRQRITIARALLQDRPILVLDEATAFADPENEAALIKALAAAMRGRTVIMVAHRLSMVTQADVILLFSDGQLREMGNHTQLLAQGGLYQRLWQHYQQAQHWVPGGTQEEVVENERQ

SEQ ID NO: 245 - protein, 1422 aa, Escherichia coli
MPSGGRMISGAPSQDSLLPDNRHAADYQQLRERLIQELNLTPQQLHEESNLIQAGLDSIRLMRWLHWFRKNGYRLTLRELYAAPTLAAWNQLMLSRSPENAEEETPPDESSWPNMTESTPFPLTPVQHAYLTGRMPGQTLGGVGCHLYQEFEGHCLTASQLEQAITTLLQRHPMLHIAFRPDGQQVWLPQPYWNGVTVHDLRHNDAESRQAYLDALRQRLSHRLLRVEIGETFDFQLTLLPDNRHRLHVNIDLLIMDASSFTLFFDELNALLAGESLPAIDTRYDFRSYLLHQQKINQPLRDDARAYWLAKASTLPPAPVLPLACEPATLCEVRNTRRRMIVPATRWHAFSNRAGEYGVTPTMALATCFSAVLARWGGLTRLLLNITLFDRQPLHPAVGAMLADFTNILLLDTACDGDTVSNLARKNQLTFTEDWEHRHWSGVELLRELKRQQRYPHGAPVVFTSNLGRSLYSSRAESPLGEPEWGISQTPQVWIDHLAFEHHGEVWLQWDSNDALFPPALVETLFDAYCQLINQLCDDESAWQKPFADIMPASQRAIRERVNATGAPIPEGLLHEGIFRIALQQPQALAVTDMRYQWNYHELTDYARRCAGRLIECGVQPGDNVAITMSKGAGQLVAVLAVLLAGAVYVPVSLDQPAARREKIYADASVRLVLICQHDASAGSDDIPALAWQQAIEAEPIANPVVRAPTQPAYIIYTSGSTGTPKGVVISHRGALNTCCDINTRYQVGPHDRVLALSALHFDLSVYDIFGVLRAGGALVMVMENQRRDPHAWCELIQRHQVTLWNSVPALFDMLLTWCEGFADATPENLRAVMLSGDWIGLDLPARYRAFRPQGQFIAMGGATEASIWSNACEIHDVPAHWRSIPYGFPLTNQRYRVVDEQGRDCPDWVPGELWIGGIGVAEGYFNDPLRSEQQFLTLPDERWYRTGDLGCYWPDGTIEFLGRRDKQVKVGGYRIELGEIESALSQLAGVKQATVLAIGEKEKTLAAYVVPQGEAFCVTDHRNPALPQAWHTLAGTLPCCAISPEISAEQVADFLQHRLLKLKPGHTAGADPLPLMNSLAIQPRWQAVVERWLAFLVTQRRLKPAAEGYQVCAGEEREDEHPHFSGHDLTLSQILRGARNELSLLNDAQWSPESLAFNHPASAPYIQELATICQQLAQRLQRPVRLLEVGTRTGRAAESLLAQLNAGQIEYVGLEQSQEMLLSARQRLAPWPGARLSLWNADTLAAHAHSADIIWLNNALHRLLPEDPGLLATLQQLAVPGALLYVMEFRQLTPSALLSTLLLTNGQPEALLHNSADWAALFSAAGFNCQHGDEVAGLQRFLVQCPDRQVRRDPRQLQAALAGRLPGWMVPQRIVFLDALPLTANGKIDYQALKRRHTPEAENPAEADLPQGDIENKYPPA

SEQ ID NO: 246 - protein, 709 aa, Escherichia coli
MLYASLCRTPVFGILAQILCDIYSSIGCALSSFRSPLGPPFDFLFDTCSCQTARCFNKSKGVLITGSKLKAFRNPQPSWGFSVHKQVAALWQQLLSTGNVTRETDFFQQGGDSLLATRLTGQLHQAGYEAQLSDLFNHPRLADFAATLRKTDVPVEQPFVHSPEDRYQPFALTDVQQAYLVGRQPGFALGGVGSHFFVEFEIADLDLTRLETVWNRLIARHDMLRAVVRDGQQQVLEQTPRWVIPAHILHTPEEALQVREKLAHQVLNPEVWPVFDLQVGYVDGMPARLWLCLDNLLLDGLSMQILLAELEHGYQYPQQLPPPLPVTYRDYLQQPAIQSLNADSLAWWQAQLDDIPPAPALPLRCMPQDVETPRFARLNGALDSTRWHRLKKRAADAHLTPSAVLLSVWSTVLSAWSAQPEFTLNLTLFDRRPLHPQINQILGDFTSLMLLSWHPGESWLHSAQSLQQRLSQNLNHRDVSAIRVMRQLAQRQNVPAVPMPVVFTSALGFEQDNFLARRNLLKPVWGISQTPQVWLDHQVYESEGELRFNWDFVAALFPAGQVERQFEQYCTLLNRMTEDENSWHLPLAALVPPVKQAEQGTERTSRVCPEHSQSHIAADESTVSLICDAFREVVGESVTPAQNFFEAGATSLNLVQLHVLLQRHEFSTLTLLDLFTHPSPAALAAYLTSVATVEKTKRSRPVRRRQRRI

SEQ ID NO: 247 - protein, 731 aa, Escherichia coli
MGPIMDNLRFSSAPTADSIDASIVQHYPDCEPVAVIGYACHFPESPDGETFWQNLLEGRECSRRFTREELLAVGLDAAIIDDPHYVNIGTVLDNADCFDATLFGYSRQEAESMDPQQRLFLQAVWHALEHAGYAPGAVPHKTGVFASSRMSTYPGREALNVTEVAQVKGLQSLMGNDKDYIATRAAYKLNLHGPALSVQTACSSSLVAVHLACESLRAGESDMAVAGGVALSFPQQAGYRYQPGMIFSPDGHCRPFDASAEGTWAGNGLGCVVLRRLRDALLSGDPIISVILSSAVNNDGNRKVGYTAPSVAGQQAVIEEALMLAAIDDRQVGYIETHGTGTPLGDAIEIEALRNVYAPRPQDQRCALGSVKSNMGHLDTAAGIAGLLKTVLAVSRGQIPPLLNFHTPNPALKLEESPFTIPVSAQAWQDEMRYAGVSSFGIGGTNCHMIVASLPDALNARLPNTDSGRKSTALLLSAASDSALRRLATDYAGALRENADASSLAFTALHARRLDLPFRLAAPLNRETAEALSAWAGEKSGAQVYSGHGASGKQVWLFTGQGSHWRTMGQTMYQHSTAFADTLDRCFSACSEMLTPSLREAMFNPDSAQLDNMAWAQPAIVAFEIAMAAHWRAEGLKPDFAIGHSVGEFAAAVVCGHYTIEQVMPLVCRRGALMQQCASGAMVAVFADEDTLMPLARQFELDLAANNGTQHTVFSGPEARLRGILRHALAA

SEQ ID NO: 248 - protein, 965 aa, Escherichia coli
MSWISPPTTVRNIRYFPGRKPVSAVFCATLSQHDINYRRLSVTGAAHSALLEPILDRFQDACAGLHAEPGQIPIISTLTADVIDESTLNQADYWRRHMRQPVRFIQSIQVAHQLGTRVFLEMGPDAQLVACGQREYRDNAYWIASARRNKEASVVLNQALLQLYAAGVALPWADLLAGDGQRIAAPCYPFDTERYWKERVSPACEPADAALSAGLEVASRAATALDLPRLEALKQCATRLHAIYVDQLVQRCTGDAIENGVDAMTIMRRGRLLPRYQQLLQRLLNNCVVDGDYRCTDGRYVRARPIEHQQRESLLTELAGYCEGFQAIPDTIARAGDRLYEMMSGAEEPVAIIFPQSASDGVEVLYQEFSFGRYFNQIAAGVLRGIVQTRQPRQPLRILEVGGGTGGTTAWLLPELNGVPALEYHFTDISALFTRRAQQKFADYDFVKYSELDLEKEAQSQGFQAQSYDLIVAANVIHATRHIGRTLDNLRPLLKPGGRLLMREITQPMRLFDFVFGPLVLPLQDLDAREGELFLTTAQWQQQCRHAGFSKVAWLPQDGSPTAGMSEHIILATLPGQAVSAVTFTAPSEPVLGQALTDNGDYLADWSDCAGQPERFNARWQEAWRLLSQRHGDALPVEPPPVAAPEWLGKVRLSWQNEAFSRGQMRVEARHPAGEWLPLSPAEPLPAPQTHYQWRWTPLNVASIDHPLTFSFSAGTLARSDELAQYGIIHDPHASSRLMIVEESEDTLALAEKVIAALTASAAGLIVVTRRAWRVEENEALSASHHALWALLRVAANEQPERLLAAIDLAENTPWETLHQGLSAVSLSQRWLAARGDTLWLPSLSPNTGCAAELPANVFTGDSRWHLVTGAFGGLGRLAVNWLREKGARRIALLAPRVDESWLRDVEGGQTRVCRCDVGDAGQLATVLDDLAANGGIAGAIHAAGVLADAPLQELDDHQLAAVFG

SEQ ID NO: 249 - protein, 366 aa, Escherichia coli
MMPSASPKQRVLIVGAKFGEMYLNAFMQPPEGLELVGLLAQGSARSRELAHAFGIPLYTSPEQITRMPDIACIVVRSTVAGGTGTQLARHFLTRGVHVIQEHPLHPDDISSLQTLAQEQGCCYWVNTFYPHTRAGRTWLRDAQQLRRCLAKTPPVVHATTSRQLLYSTLDLLLLALGVDAAAVECDVVGSFSDFHCLRLFWPEGEACLLLQRYLDPDDPDMHSLIMHRLLLGWPEGHLSLEASYGPVIWSSSLFVADHQENAHSLYRRPEILRDLPGLTRSAAPLSWRDCCETAGPEGVSWLLHQLRSHLAGEHPPAACQSVHQIALSRLWQQILRKTGNAEIRRLTPPHHDRLAGFYNDDDKEAL

SEQ ID NO: 250 - protein, 415 aa, Escherichia coli
MNSSFESLIEQYPLPIAEQLRHWAARYASRIAVVDAKGSLTYSALDAQVDELAAGLSSLGLRSGEHVIVQLPNDNAFVTLLFALLRLGVIPVLAMPSQRALDIDALIELAQPVAYVIHGENHAELARQMAHKHACLRHVLVAGETVSDDFTPLFSLHGERQAWPQPDVSATALLLLSGGTTGTPKLIPRRHADYSYNFSASAELCGISQQSVYLAVLPVAHNFPLACPGILGTLACGGKVVLTDSASCDEVMPLIAQERVTHVALVPALAQLWVQAREWEDSDLSSLRVIQAGGARLDPTLAEQVIATFDCTLQQVFGMAEGLLCFTRLDDPHATILHSQGRPLSPLDEIRIVDQDENDVAPGETGQLLTRGPYTISGYYRAPAHNAQAFTAQGFYRTGDNVRLDEVGNLHVEDA

SEQ ID NO: 251 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 252 - protein, 504 aa, Escherichia coli
MTIMEHVSIKTLYHLLCCMLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 253 - protein, 1120 aa, Escherichia coli
MASAASFTSSAAMESGGGALPTLGYGGGTMMSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGLPARAVTQQAAYINPAAASFAQCAGR

SEQ ID NO: 254 - protein, 479 aa, Escherichia coli
MTVNKLEPDNGTPNDELFTVAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 255 - protein, 2154 aa, Escherichia coli
MTYSESDIAIVGMNCRYPGVHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 256 - protein, 2166 aa, Escherichia coli
MTIHHAALARMLPAEKKEKLLRQLAQSGVSPSRIPIIKADPAQAIPLSFNQERLWFLQKYDSTATNYNLYVVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQTQQRDASRSRAQQRLVRRHQRQR

SEQ ID NO: 257 - protein, 1010 aa, Escherichia coli
MAENDFGIAIIGMAGRFPQADTVQAFWENLLASRECISFYSDEELLAMGISPEFVQHPDYVKAKGEVADIDKFDAAFFGIAPREAELMDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 258 - protein, 1603 aa, Escherichia coli
MKARVMEQQGIMRQLPTDDQTIVDYLYRIAGEYGEKAAVLMGDAALSYHDLNARSNQLAHYLRGLGIGEDRVVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 259 - protein, 342 aa, Escherichia coli
MPDIISCVAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCQAAVDVATRYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 260 - protein, 65 aa, Escherichia coli
MFGKQDCLLLSQLIIFSAHSLLQACLSLNELHYFIDGSNLFCFQLTHFQLNLKIFFYKQYDLHSK

SEQ ID NO: 261 - protein, 82 aa, Escherichia coli
MKKQDMKAAIREFLSRSLRGHTLNDDDDIFSLGLVHSLFTVQIILFIEKNFQVELEVSELKTEQIATVNKIVELIQRQTGLE

SEQ ID NO: 262 - protein, 289 aa, Escherichia coli
MMNVAVIGAGVMGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 263 - protein, 869 aa, Escherichia coli
MKFMEYASEMNGMEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 264 - protein, 1352 aa, Escherichia coli
MRRNCWYNPRCLSNVGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 265 - protein, 1875 aa, Escherichia coli
MMVMDNTSGDFPCNKMDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPG

SEQ ID NO: 266 - protein, 88 aa, Escherichia coli
MRKARFTEHQIIAVIKSVEAGRTVKDVCREAGISEATYYNWKSKYGGMEASDIKKIKDLEDENRRLKQMFADLSLENRALKDVIEKKL

SEQ ID NO: 267 - protein, 42 aa, Escherichia coli
MEFLMTKTIVMEFFVLICPLCGQANERIVFVEGFSTLFSIWG

SEQ ID NO: 268 - protein, 321 aa, Escherichia coli
MKKNKYSTPLWMLATILAGMLSPMQSAVNGQLGHWLQDGNACAVISFASGLVVMFFIIMARKETRQQFAAIPSLIKNRKVPLWNWFAGLCGAMVVFSEGASASALGVATFQTALISALLLSGLLCDRFGIGVDEKKYFTPYRIIGALFAVIATIFVVSPQWHSTSFILLAILPFLAGLLAGWQPAGNAKVAEATGSMLVSITWNFIVGFCVLGTALAIRVALGHVTVQLPDVWWMYLGGPLGLMSIGLMAILVRGLGLLMLGVASTAGQLLGSVLIDVLIPSLGNTVYLVTIIGTLFALVGAIVTTIPEYRTSKTMKKMEV

SEQ ID NO: 269 - protein, 398 aa, Escherichia coli
MTESSDYESVQVFIGVDVGKDTHHAVAINRSGKRLFDKALPNDENKLRSLISDLKQHGQILLVVDQPATIGALPVAVARSEGVLVGYLPGLAMRRIADLHAGEAKTDARDAAIIAEAARTLPHALRTLKLADEQIAELSMLCGFDDDLAAQTTQASNRIRGLLTQIHPALERVLGPRLDHPAVLDLLQRYPSPEKLASLGEKKLAAQLCKLAPRLGKRLAADIAQALAEQTVVVPGTNAAAVVLPRLALQLITLRKQRDEVALAVEQRVLAHPLYPVLTSMPGVGVRTAARLLTEVACRAFASVAHLAAYAGLAPVTRRSGSSIRGEHPSRRGNKALKRALFLSAFAALRDPLSRAYYTRKMSQGKRHNQALIALARRRCDVLFAMMRDGTFYTPQAS

SEQ ID NO: 270 - protein, 125 aa, Escherichia coli
MFSAITSIFAVFFFINRMQCSLSVKTSSLLLRRRSHFWSFPGERLSDERAGFTVRGTPRSRPVLPFPRSGTNNALRLILFEASGTAGSSPLRGHRFLPTSHNTVRLSCSNTRNAVCGFKCTDNAS

SEQ ID NO: 271 - protein, 352 aa, Escherichia coli; identical to SEQ ID NO: 35

SEQ ID NO: 272 - protein, 330 aa, Escherichia coli; identical to SEQ ID NO: 34

SEQ ID NO: 273 - protein, 721 aa, Escherichia coli; identical to SEQ ID NO: 33

SEQ ID NO: 274 - protein, 261 aa, Escherichia coli
MVVFFLAGVIENIFRYILPERKFYPSPVNSLTGNLIMQLPVKLLMSLISLVSVIARAGKYKNYIRDEIKYWRYTSYKGGEFPEGFTDEKFSSAIYNGRIFTMKRLHTLMLFLAVLFTGFNVEAASVKQALSCDPNARAEQPGACPTTYELYEGDAAYKAALDKALKPVGLSGMFGKGGYMDGPGGNVTPVTINGTVWLQGDGCKANTCGWDFIVTLYNPKTHEVVGYRYFGLDDPAYLVWFGEIGVHEFAYLVKNYVAAVN

SEQ ID NO: 275 - protein, 136 aa, Escherichia coli
MKTFIKTLLVAVTILFSVFATAKQVKLPNNIKYVNTTEAFSCTEIDGMNCQTKNPFNYKDNSYVFVLERGGAWCYDYTVSVLNLKTGKAQMLEYKDNQLCSGSNKPFFEIKNGVPTVGVIDTSGKPVVVALDKLKT

SEQ ID NO: 276 - protein, 161 aa, Escherichia coli
MTTSSHNSTTPSVSVAAASGNNQSQLVATPVPDEQRISFWPQHFGLIPQWVTLEPRVFGWMDRLYEDYCGGIWNLYTLNNGGAFMAPEPDDDDDETWVLFNAMNGNRAEMSPEAAGIAACLMTYSHHACRTECYAMTVHYYRLRDYALQHPEYDAIMRIID

SEQ ID NO: 277 - protein, 179 aa, Escherichia coli
MKMTVQGFQGPQNETALAGRHLSGQKGNLLHCSCPLSVNDAHNGVVFRMLQGVIPQTVIMNRHGITLRTAGVMTVRHQTGSNAGGFRAHFSAVTVHGIEQYPCFVIIVIRFGCHKCATVVQGVQIPDTTAVVFIQTVHPAEDTGLQGDPLWNEAKMLRPEADALFIRDGSGNQLRLVIP

SEQ ID NO: 278 - protein, 483 aa, Escherichia coli
MRNYMNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 279 - protein, 371 aa, Escherichia coli
MLCKELSKKYDLILLSLCDQPLELEININDSVFKEIHRVYLPKYKSYYNVLKALVTQKPLQIAYYQSDTFKNKYNKLIKQCDAVFCHLIRVADYVKDTDKFKILDMTDAISLNYSRVKKLASKKSLRAIIYSLEQKRLESYERSVANLFDLTTFISSVDRDYLYPNPGSNIHIVNNGVDTSALRYIKREIKIDKPVELIFIGNMYSLQNMDAAKHFAKNILPCLYDEFNIIFKVIGKISETNKNILNSFKNTIALGTVDDINSSASTGHIGICPVRLGAGVQNKILEYMALGLPCITSSIGYEGINAKSGSEIFVADTVEQYKNVLREIIYDYNRYTEVAENARSFVENNFSWESKVANLMNTLDEKLYEQ

SEQ ID NO: 280 - protein, 381 aa, Escherichia coli
MKKNKKLCLISINSYNELTGGGVYLRTLVSFLQKQNVNLTLIDKKSSGKLFEDNTFQHISFIKGKRQDIISRLFFIPSFYVPYIFSIIKILRKQDILAFHNSRLGLLCLLFRILMPHKKIILFTDNFEYDLIRQKDKNITTFIEKLIVYLNEFIGLKNSDLVSYITRQDKNAMDKFYGIKKSRNLILPVIFSREKPTDVLSAHFINEYNRLNNDNRKKVVFTASFDFFPNIDAANYVLNAAKSNNDYCYILAGRKSTTLNLPDLDNLFFFDNLSNSEMSYLLSACDVFYSPIVLGSGMKTKIAEALSYGLYIYATEHSLIGYDEIINNKECVKKISHLDEEFPKDFKMKSINKQLIMSYQQKYYSHYRFNGHELDIINFDD

SEQ ID NO: 281 - protein, 453 aa, Escherichia coli
MGSESIMKVKAVPAITFYLSLMLTILVLLFGNEPNKSQYILVIATITVFYIAYITNKITSPASLLVISSFVFLGCRPLLSLFANYDYRIADWFIEGYMDDDVILANYAITLMYYGYTLGLILCKNTEKFYPHGPYPEKQLLKIKFLLTLFFLGSIGMVVKGIFFFNFIESNSYVDIYQSNITTPIGYDFLSYLFYCSFFLICAFHIQFRTNKKFLFIAICIAAFSTLKGSRSEAITFLLTVTCIYFNEVKTRNLRLLITMIFVFSVIFVISEFISMWRTGGGFFQLMQGNNPVINFVYGMGVSYLSIYQSVKLQLLSGGYNVTYLFSQLIITCSSIFNVKLSLPEISYSHLASYTANPELYNLGFGLGGSYLAESFLAFGLIGCFIIPFLLLLNLNVLEKYTKNKPIIYFVYYSVLPPILFTPRETLFYFFPYLVKSIFVAFLVTLYIQYKKD

SEQ ID NO: 282 - protein, 40 aa, Escherichia coli
MIFYLIYFIVLFSLYVRFIYSSEQIKNFFLLRYALLHLAP

SEQ ID NO: 283 - protein, 418 aa, Escherichia coli
MNRIQRVHNYLRLKDKIKNVFLGLYILQLFNYIAPLVIIPILIKYIGLGEYGELVYITSIYQIVALIIDFGFTYTGPVVAARHRCETQNLQRYYSIVVLLKSLLFIIALTCVFLLCRLNIVHLSFFGFLSIFLCTIGNILSPNWFLQGIGDFKKLSYSQVIVRITLFIILLVYVCSGGDNVFILSFLQNATLLICCIYLWPNIHISHVVHLKPNECIVEFKKAGNVFIGVIGTIGYNGLIPVLIGNLCGNTSLGVFSIVQKMTTACQSLINPISQYMLSQVSEIKPQDKLFYYRIKKSFFVHLTISIIACLCYMGLGQYVATFIGKVDVSFVIILFASIITIFSSLNNVLGIQFLIPTDNVKILRSINVMAGIIVVSLSWLLISRFDILGGVLLNLIGEFLVFSMLAFIAHRKWGARV

SEQ ID NO: 284 - protein, 52 aa, Escherichia coli
MALTETANFVFVVIYIAVSHSLPDATLPRLIRPTNPNRRSDKAFTPHPTNSA

SEQ ID NO: 285 - protein, 204 aa, Escherichia coli
MQTMLMLKKGMMLVGLIFFSLPANAGCTLEETARKVIMGFQQEDAQLINSLIDKKTGLYVLFHRGASMDVENLKQINFRQPVPEYFPWPSAGEHVPRDDEFNKKAIPKFNCERGWNKQGYFISNSDVHHKVSRSLVFTQMFGSPQNTISDAQIAAARRMEYGAVRVVAAPEESNDGLVFYLSQLYSYDSDWYLTVVDQIGDCGA

SEQ ID NO: 286 - protein, 238 aa, Escherichia coli
MSLIIVLLVAIFIFIYRYKKNKPQIDAFIAKEKEKDLIKDKRRATKRRKWALAIGDIVARRNGLSVNGFTLDLKLTDDKRQQLALQVKQELGTETYQSNEDFRQQIGVILQRWATGLGNSPHDFYEQLAAQGQVLDGLAFDCMRTAFLTRCIAGLGWCDENQAWIVLLLNAQRAQDCFASWEDYASAYVRARQKWLMIYDTPVATANRDLKEVTAWLKDPSSNWKKLPWNEFKIFEPN

SEQ ID NO: 287 - protein, 48 aa, Escherichia coli
MRAIIILVVTGEFFHLLDVFSAFSVGSIHQKKCYRGQVFTAKVFKRYY

SEQ ID NO: 288 - protein, 1262 aa, Escherichia coli
MRHFIYQDEKSHKFWAVEQQGNELHISWGKVGTQGQSQVKSFADAVAAEKAELKLIAEKVKKGYVEQAKDNSLQPSQTVTDSLKVADLSTIIQEQPSFVAETRAADKNTDAVLPWLAKDIAVVFPPEVVHTTLSHRRFPGVPVQQADKLTQLRRLACSVSQRDNTTATFDFSACSLEWQNTVAQAISQIDDLKTTQLPSPVMAVLTALEMKCTRYKEREDVMDQIIQEGGLEYATDVIIHLQQISIEWDYVNNNIVFLSSGISPDYLQQYSSFELRLRKHLSLAEESLWQKCAQKLIAAVPHIPEWRQPLIALLLPEKPEIAHEIAQRLLGQKKLPSLEWLKIVATDEHILASLEKYHEPYAIFDDYYCGAIWSATVLQEQGVAALPRFAPYVASDYCADVLRHINHPFALTLLIRVAGHTKRCHDRMTKACAAFPHAALAALAELLVQKEENSWRIMLMTMLISQPTLAEQVIPWLSTPAVAVLKSCQQQLTQPSNHASADLLPAIVVSPPWLSKKKKSPIPVLDLAPLNLESICTITDTEAKEFQTHWDWEPHKPGEGAKNFLYSLGYRRWDFDTYKYIGASDSAIDAWEREDFATLIQMFKAHHAPYQGEWHLNSLPFLPMQKAIKLWEFLSKEPHTAIKPVMLYLRLAGMSGFLHSFSRYPQEGFAVANYFAATELAPAVARAFNKLKTLRQDASSWLLKYPEHAITGLLPAALGKASEAQDNARAALRMLTENGHQPLLQEIARRYNQPEVTDAVNALLALDPLDNHPTKIPTLPTFYQPSLWTRPLLKANAQSLPDSALLHLGEMLRFPQEEALYPGLLQVKDACTTDSLAEFAWDLFTAWQTAGAPSKESWAFTALGVLGNDDTARKLTPLIRAWPGESQHKRATVGLDILAAIGSDIALMQLNGIAQKLKFKALQERAKEKIADIAESRELTVAELEDRLAPDLGLDDNGSLLLDFGPRQFTVSFDETLKPFVRDASGSRLKDLPKPNKSDDESQANDAVNRYKLLKKDARTVAAQQVARLESAMCLRRRWSPENFQLFLVEHPLVRHLTRRLIWGVYSAENQLLACFRVAEDNSYSTADDDLFTLPEGNISIGIPHVLEISPTDAAAFGQLFADYELLPPFRQLDRNSYALTEAERNASELTRWTGRKCPSGRVMGLANKGWIKGTPQDAGWIGWMINPLGRWSLIMEIDEGFAVGMSPAELSAEQLLSKLWLWEGKAESYGRGSNSTQEAQFSVLDAITASELINDIEALFE

SEQ ID NO: 289 - protein, 83 aa, Escherichia coli
MPFFSYLATVEKQVFLAGRCYEYSRKQVLAMPINNHSPLPGLEYLTTASPLLPVVAAMPSAFVTAYASIHHVLFAVQAAFGLR

SEQ ID NO: 290 - protein, 50 aa, Escherichia coli
MFVGRIRRLRRIRQETPGKICPLSIYLILQLNPSRQANPVIINYAFLLIR

SEQ ID NO: 291 - protein, 351 aa, Escherichia coli
MLIMNMCLNLNTCSNSLIDCNDYFTQFLRWQFIARGRAMREKDYIVIIGSANIDVAGYSHHPLNYADSNPGKIKFTPGGVGRNIAHNLALLGKNAWLLSAVGGDFYGQSLLAQTNQSGVYVDKCLIVPGENTSSYLSLLDNTGEMLVAINDMSISDCISAEFLAQHQEFIRGAKVIVADCNLSEEALVWVLENSGETPVFIDPVSAWKCVKIRDHLSKIHTLKPNRLEAETLSGIALSGREDVAKVAAWFHQHGLNRLVLSMGGDGVYYSDINGESGWSAPIKTNVINVTGAGDAMMAGLASCWVDGMPFIDSVRFAQGCSSMALACEYTNNPELSIANVTSLVENTECLN

SEQ ID NO: 292 - protein, 42 aa, Escherichia coli
MNNLKNIQIILPALLVLNSDEKTNQQKYLWRINRYINMFITI

SEQ ID NO: 293 - protein, 72 aa, Escherichia coli
MGDFIKAMLLGIGFVWLTTFAGAKASGKRLTGIGIERNVFPQSMSGAARRTAKDACGAHGENEFAVGIRVAG

SEQ ID NO: 294 - protein, 364 aa, Escherichia coli
MYAENNEKRARRPFVRYKSRLELVNQTQSYDVISVDASSAGELVVVQQVDFVVNVGGHVFVEVVGSTNINIFQDIFVVVVTTSNDTQVFTFRLQVCYRRTQTKVELVLSNSFEVLCFVRPTQGTYASCVVGLGVLSSQVDVVSVVFQTTSVGFSTVASTDQASVVLIPGTFGAGNCSTNAEAFVIISDRSADTVAVLTQSFTTIVGDAMTSEIRIIFTAYAAILALVLNSKVQAVNQTEEVGVTVGREAVTTLLHEVVRTVGVATEFWQNVGPGSYVVNNAVVTTVVERTDVLEFQTSKCHTGPGVVFAFRSVALDLIFPLAVTGQLVSNLSFTFEAKTHVGLVAIYRLVVREIVQAVYFTVQI

SEQ ID NO: 295 - protein, 1254 aa, Escherichia coli
MNMRIISLRKEYLSLLPSMIASLFSANGAAAVIDSCQGYDIKANCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEMSIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAISLQNGVAGDTLTVNGDYTGGGTLLLDSELNGDDSASDQLVLNGNTAGNTAVVINPITGIGEPTSTGIKVVDFAADPAQFQNNAQFSLTGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYAWFNNDVSEQDDGVDHYHSSGIIASLEAGYQWLPGRGVVIEPQAQVIYQGVQQDDFTAANHARVSQSQGDDIQTRLGLHSEWRTAVSVTPTLDLNYYHDPHATEIEEDGSTISDDAAKQRGEIKVGITGNISQRVSLRGSVAWQKGSDDFAQTAGFLSMTVKW

SEQ ID NO: 296 - protein, 153 aa, Escherichia coli
MIDWQDLHHSDLSVSQLYALLQLRCAVFVVEQNCPYQDIDGDDLEGENRHILGWHNGTLVAYARILKSDDELQPVVIGRVIVSEALRGEKIGQQLMSKALESCTRRWPEKPIYLGAQAHLQNFYGQFGFIPVTDIYEEDGIPHIGMAREVIQA

SEQ ID NO: 297 - protein, 40 aa, Escherichia coli
MHMKKNKFCFYYIISVFTPSDYFLPTLGECITANAPTRKS

SEQ ID NO: 298 - protein, 290 aa, Escherichia coli
MSTYKMKKTNLLFRLLILMVFMLGSRAGMGQTFRNVYIYYATFGWNSQVELYLDVAEVSSVYYGTYYQSNYVMTLGNLPNRTWTGTGSSPAPTITVKDGTIVNNSFCPGMEALEAKDSRWECLKLPLDITVDGDVGGCPWLVSIRATSQVVVGSVDKDIYYGPNATVSVCPTVSVTPYDVSWDENYINKTKTLSLQSTGGVIEKTLSTYLMKDGKLCDGSQMNEEGAYCRWVAQMITFSSSGCDNANVTVAPNRHPITDKQLHDMVVRVDTSSRQPIDSTCRFQYTLNEL

SEQ ID NO: 299 - protein, 175 aa, Escherichia coli
MNLKRISHCAAVLATVLLTPHVQAADNLHFYGNLLSKSCTLVVQGESLAEVHFPTVSRKDLMVTGQSARVPVVFQLKDCKGPAQYEVRVTLTGTEDSEQPGFLALDVSSAAQGVGIGMEKTDGTPVPINNTSGATFVLSNGNNNLNFNAWLQAKSGREVTMGEFTASLTATFEYI

SEQ ID NO: 300 - protein, 159 aa, Escherichia coli
MKRLAWCLIYGFAGLAQAAINDVTFHGTLVSPPACTISDGKTIEVEFRNVIIDNINGDNFRQDVPYTITCDPDVRDDAWEMSLTWTGSQTPYDDSAIETDVSGLGIELQQNGQPFKLGTPLKIDPSTPPTLQAVPVKANDAALSDGTFSAYATLQVDYQ

SEQ ID NO: 301 - protein, 167 aa, Escherichia coli
MKAFFLTGSAALLLACGVTVFPAMAGGKIVNLTLRVLVDGPPPCSVKGSAVEFGNVIIKSIDGANYRQAVGYTLNCSNSVSDDLQMQLQATTTTINGETVLSTGISGFGIRIQNAADHSLVAVGNSSWLPFNINTQPDFEAVPVKQSGVELMASEFNATMTMVVDYQ

SEQ ID NO: 302 - protein, 250 aa, Escherichia coli
MSYKLSCPMLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 303 - protein, 884 aa, Escherichia coli
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQTRQVTPTEAPTSISATQ

SEQ ID NO: 304 - protein, 188 aa, Escherichia coli
MSKFAKTAIAAAMVMGAVVSSSAFAAGNNGTARFYGTIEDSPCSIVPDDHKLEVDMGDIGAAKLTGGGTTTPKDFQIRLQDCVFTTETNMETTFTGTNYAGPANTDNYALFNVDSGVAMNHVSLVIGDTHGKGYKVGEKIVQPIVMDTSTSKGKDKQTLNFKAWLVGETDAPDLGQFETLTTFQITYL

SEQ ID NO: 305 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVDITGHSDLTGQSANAKNIAPTAWVPNLHFVAPINDQFGWGASITSNYGLATEFTDNYAAGIYGGKTDLQTINLNLSGAYRLNNSWSFGLGFDAVYAKAKIERYAGSLGPLLSQQLIAQGVPASLTNGINTPDSQIAHLKGDEWGFGWNAGILYELDKDNRWGLTYRSEVKIDFDGDYKSSINPNLNNILGNMGLPYGTMGATQNGSLTLNLPEMWEISGYNRVAPQWAIHYSMAYTSWSQFQELKAKGDSGQTLFYKDEGFRDAYRIALGTTYYYDKNWTFRTGIAYDDSPVPADKRSISIPDQDRLWLSAGLTYAFNEDASIDVGASYMHGQKVKFTEGEGAAAYSFESEGKAWLFGTNFNYAF

SEQ ID NO: 306 - protein, 176 aa, Escherichia coli
MSSVMKFSVVNAVVLLLLIVLTGVFYMKKSKEIAVVNIDAIYNQSAAGDMVRKHLNEVKSILEKGYEDAQKAFADNANKEALLLDARQKLERQCVIEENSAKMVLSRAIDNAIGTWRKDNPKNIAVLSSGVVLAHNESADITKEVMALVEKENLVFNQLPKVEVHNKNEEKPEQSK

SEQ ID NO: 307 - protein, 2387 aa, Escherichia coli
  Xaa 2363, 2376, 2380: Xaa is any amino acid
MNKVYKVIWNHTTQKWDVVSELTSCRKKCKSTRLGIALSAMVLGGAIAINCNNAMADVILSPDWRPGTNNSGVGAATVSGKTEYITGPNVVQSGGSGLIWMTVEQAILNGYTTGDNLSGLIYVNTGEKTKTITVKDEVTGASQTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAGTVDVVNKGTITIDGHDSDAPALNVGMLANNSSGMKNSGIINVNGLNSTGLQVINAGQLNSDGTINVGGKGISSGFRNYGAWVEGAGSNVNVSGKISLAGTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFAADGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINNGNIDFTTGTDNIGVWVDNGRFENTGSRIAVNGVALFVEGAQSQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSAGLVINLKGTDGTGIFANTKDGAVVKSGASVNVIQADGGSALVVNNAASEVVQSGNLISASLSHAVVDASKAQSFTNKGQIKAASTTGTAMAFDDAVNTTVLNDSGAEIQGVVALNGGDNTFTNKGSITGTVSAKEGNNTFLFDDGSTLTGEVTAGNGNNNVTLNGKTHVDQVTAGTGKNTFTIKGEGATWNLLDGGQGDSDSLIFDNAIHTLDSVVKLQNFEHVGLKNSSLVTLKEALVLTDGGNGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGIKGDGLYIGYGLKSLDLQGTGDKALVLTPRANAQGLQTDLGAQLTGAGDLAIEAAGQVVTLSNGGNNYTGDTLVRSGTLQMANDNVLGATGNLNVASNAVFRTNGYSQTVGALQTETGAHIQLDSGSVLTVSGTQRQPGDDNGGIIENNVLSGEGTLAVTGSNLTVHGTNIGFTGNASLTQGALVEMNGAQGLGSQGSISFESLNDRLAIDIADGSGVSSNLSKSLSGEGSVGILNTTDLTLSGDNSNFSGEFRVQKDAALRASDEKHLGTGLIDSDGVTWLTASGNWLLKNDITGSGALVKQGAGNLIINHELTYTGDTTVESGVLIVGDDSVTRAAGATLSGSKNIHVLNGGTLSGLGTVSGQVNNQGTLASLNALSGYETAEVGNFTVGSLTNTGVIRLAGGKTGNTLTVNGDYTGGGTLIINTVLGDDTSTTDKLIVTGNTSGDTGVVVNNVRGQGAQTADGIEIVHVGGQSDGNFRLQNRAVAGAWEYFLHKGNAGGTDGNWYLRSELPPEPQPQPQPQPQPQPQPQPQPQPQPQPHPTPDKPVQKVYRPEAGSYIANIAGSQHAVQHQNALIVRGKLTIPMCLLXRRKQQVCGCVISXVIIXGRTAVHS

SEQ ID NO: 308 - protein, 91 aa, Escherichia coli
MKVNLMLFSLFLFVSIMACNVFAFSISGGGSEASYKETEKTSVMTTTHSTKLQPSQAILFKMREDAPPLNLTEDITPTYPTKANYLIHPLR

SEQ ID NO: 309 - protein, 119 aa, Escherichia coli
MRQTQVKSPYCHQSNYKLAIAIITVITGTVVTGATVTTGTAIMNGVKTAGGIMIMATIVAGISVKRMNVAIVKAGAIVTIIVEKAADMDTAIKHIRQWSTMPDATLARLIRPTNQLFNA

SEQ ID NO: 310 - protein, 2683 aa, Escherichia coli
MSLTLNKILVLCALLISAMLPGWSWAESAWQDSSDTVGEFNGTVPTADSASIPVYQGSVFLDPTKTHEVAFTAKPSEFNADVSVSKLLVTNPQDREGDIIATPRWENQTPPAVSLVWADAATPDTLLDPQPVADRSFCAQGLAGRSLVAWAQPDPQQTMPLLYLLTSTGYPYESVLTLADQKVTLKIAPAQGDLISVSAAGYDESSGAAKMTVGGSITLTVTTKDCVGNVVGNIPFVIKRKDAENRQGVVNNTAPVKLGTTELTTTATEYRGTTDANGVATVTVTQANGPGVKTPLVASLAGIAQASETAVIFTVLTSPDVPQATMWGHMPDTLKARDYTFSRPKLAAEVDNEGGTVNDHNETWSTFTWSGADKHCDILPGMRQFGALATVVPTSVQDVAGWPMQGNFYWSSLAGMSGQHHAADVSNRSEAQKPDDTTFIVSCVDKEAPDVEPKLVLTPGSYDSTIKAMKVKVGEEASLRLTITDSKNNDQPLAYYYFSLHLDDGINRKNQTDAAWETHPVQIDGGSNVRKVDAHTYEGITDANGEATLTLTQPGGVGVKTHITARMRSDFTASDEKDVIFTVITSPDTDKARMWGHMLGIIEANNIFKRPRLADETDNELGSVRENNEDWALFDQNSSMQAECGLGHIPSQSSLHSLFAAHPANAIGTEYGWPTLQKAYLSAVEETSHASVNLATGNIDTYSGFKQNYLSCSGNEMVAKIAATTDRDVSAGSRAQAKVGDTITMTVRTFNALNNAPVPYTAFTITKDMGKNRQGQTTGFDDPTRGAIEMNGTLYGTSQPSLVYAGTTDAQGFATVEIKQSQGVGLSTPLNIVPVNSYIPNTVNYNVIFTTLTSPDAVGAQMWGHMDETITVDALTFARPRLAAEVFSPDGTLTENNEVWSRVSQANASSTSKGGCGANMLPRRSQLSALYDANNGNGVQTVHGWPTQRQPYWSSSPADQVPHYYTIALNDGARTVGGSTAVYVSCLTTANNPASSITLEVVDPAQWNAAANAAKLKKGETLQVKVTVKDAQGNPLGDIPFTLKRGDGYTRSEEKHVAGSSDALVAPVVVNGGLADETSLNNTAAAYSAMTGSDGTKILTITRPDTHGTKTSLTARLYSDTTKKATLDTIFTVVTSPDSDKAKMWGHMPETVTAADGAVFKRPLLLKELSSTSGRTAIAEDNEDWAQFTQAQAISTSSNGCGSEYVPSQAGLESLYEANRGNAMKTVQGWPVASSYLSSTTGSSSLEQRDFKAVNLSSGTSSIIPSATKELLTCQTTPIVKASQIVLEAADLTKFDRMNNVVKVKKGEEAVLRVTTKDAQGKPVGNTAFTLKRNTSVNRANVSTTTSIASLAVTDAWGNTQNDFLSTTLVIYGVTGADGTTTFTLKQDQTTGLKTELTAALDSSSSTKSTLPVVFTVLTSPDSPKAKFWGHMAETATGDDGLIYRRPLLRDENSATTSIGTLVEEGEAWSTFPSGQANDTSINGCGAEYVPTDNELRAIYAHQGSSALHDAIGWPVSRFYISNTVADTFTQTFTYDVVSLKTGDETQMPSSGGALLSCRTTPVAVASQIIVEANDTAQFVKVDDTLSALKVKKGEDAVIRVVTKNAQGNSVPNVPFILRREGSKNRQNAEMINKSITVINAAGASARMNSSSSLLYGVTGADGTTSFTVKQDDSMGLVTNMYAQLYQLTIESNKLPVMFTVITSPDTPLASYWGHMPETFTTRSGIAFKRPLLTAEHPAGQSTMANNESWLSLNTAAKNDVSKSDCGEPYQPLLSEFQELYSEHPNGAIGTDLGLPLTNTWWAYDKIAYANVWYDQSINLSNGSSSRALSNTVAFVSCLVNPHAVAASIEMTSTALDAEKTASNDGRPSATAAKGTAIRMTVIVRDSGGNLLPGANFNLIRGTALDRAKNRLDSTYDDLTIVPVTPAGVNMSLYNNGAQALLTTGSDGKATFDVTQNETYGLATPLTATLMRDTTKSATMDVIFTVITSPNSPKAKYWGHMPDTFTSRAGVTFKRPLLAAEATLGSSVSNNNESWSYLFYTNKVTPDCPVEYQPRLNELQGLYNDHPGGTILTDLGLPITAGSGNWWTYEMSTTDALTWYYGVINLKTGQSTTTINGYALMLCLTQPHSAPASLTLSSTAYDEGRTASNGGTPTSSVKKGEMLPIVVTIKDANGNPVGGEGVTLKRVQAKSRSGISVSSNTVDDLILDEVTPTSARISFNQNTSAWSGFTGSDGTITFNVTQNNTVGLVTPFTASLARNPQVTANQDLIFTVVTSPDSAKANYWGHMPATLTAVNGAVFERPKLWSELTSTSGVGKINNNNEDWPYFTPTQKSDASVSPCEVARQPLFNDLSSLSARYPNNTFVTETGWPAYYTWWAEDKSADGKDQSVDLRNGTLYTGSTKSFQPCLANARSTVSSVTLTSTAFDAATQAAKVKKGEAMSVTVTVKDSAGNTVPNVEFTLKRGEASPRNAGATLYGNVVAMDDLVVQPLSGSAVTLSESGNTISGMTGADGTASFSLRQDNTPGYKTPLTVTLANYASATDTLDAIFTVPTSPNVSSAHFWGHMADTVVVNSKSLHRPLLTTELPSGANPVSSPIINYENWASAHIIDASKWDIARQCGSIENAPTYNELELLHTVFNSLGWPSSPSFPYLSSQQCGMDEGTGAQDCSITLINKPGLVTCFQ

SEQ ID NO: 311 - protein, 325 aa, Escherichia coli
MKQDKRRGLTRIALALALAGYCVAPVALAEDSAWVDSGETNIFQGTIPWLYSEGGSATTDADRVTLTSDLKGARPQGSETDKRFYSGDKLTVSWEIGDTEGDVDLGGLGDNAKTIDTIRWMSYKDAQGGDPKELATKVTSYTLTDADRGRYIGIEITPTTQTGTPNVGTALHLYDVSTASGGGSDSDNVAPGPVVNQNLKVAIFVDGTSINLINGSTPIELGKTYVAKLYSDENKNGKFDAGTDADVTANYDFRWVLSGSSQQLGTSGGIVNSSFDNNNLVIPATNDEARTNLNGPARDGKEALSIPTNGDGVQGYKLHIIYKHK

SEQ ID NO: 312 - protein, 735 aa, Escherichia coli
MTVSLSQGKCMLRWKRCIILTFISGAAFAAPEINVKQNESLPDLGSQAAQQDEQTNKGKSLKERGADYVINSATQGFENLTPEALESQARSYLQSQITSTAQSYIEDTLSPYGKVRLNLSIGQGGDLDGSSIDYFVPWYDNQTTVYFSQFSAQRKEDRTIGNIGLGVRYNFDKYLLGGNIFYDYDFTRGHRRLGLGAEAWTDYLKFSGNYYHPLSDWKDSEDFDFYEERPARGWDIRAEVWLPSYPQLGGKIVFEQYYGDEVALFGTDNLEKDPYAVTLGLNYQPVPLLTVGTDYKAGTGDNSDVSINATLNYQFGVPLKDQLDSDKVKAAHSLMGSRLDFVERNNFIVLEYKEKDPLDVTLWLKADATNEHPECVIKDTPEAAVGLEKCKWTINALINHHYKIVAASWQAKNNAARTLVMPVIKENTLTEGNNNHWNLVLPAWQYSSDQAEQEKLNTWRVRLALEDEKGNRQNSGVVEITVQQDRKIELIVNNIANVPEENNHSHEASAQADGVDGVVMDLDVTDSFGDNTDRNGDALPEDNLTPQLYDAQDKRVTLTNKPCSTDNPCVFIAKQDKEKGTVTLSSTLPGTYRWKAKAAPYDDSNYVDVTFLGAEIGGLNAFIYRVGAAKPSNLIGKDKEPLPLNNIYRFVLWRDNNKDGVFQQVEKLTDEEMVQYDYKWEFTGKSINGEVGAQANTSNEDIVIPATNREAAQTYGAQAGDGLQGYGLRVLYTKK

SEQ ID NO: 313 - protein, 47 aa, Escherichia coli
MRFSPVSSFFFTCCVVGRSFLSFPDMQDNRQEAGSNILIFQLAPTFD

SEQ ID NO: 314 - protein, 97 aa, Escherichia coli
MDITPFLHALCAVAAQLLVGLFTGNWAYGAIAGCTFFIAREHTQAEYRWIEMFGHGKRINMPWWGGFDPRVWDVASLMDFAVPVVACLLVWLLVNRG

SEQ ID NO: 315 - protein, 146 aa, Escherichia coli
MAFVSLVFAAVWLDFALVSLVFAAFWLLAAAVADPVAEVAEPAAALSLWAAATWLFFAAVSLALAFVSLVFAAVWLDFALVSLVFAAVSLFFALVSDFLAAVAEFSDAVCEVAAACALLAAFVSEVFAAFFDDAAAVSDFFAAAAL

SEQ ID NO: 316 - protein, 210 aa, Escherichia coli
MARICLYGDLQRFGRRIDLRVKTGAEAIRALATQLPAFRQKLSDGWYQVRIAGRDVSTSGLTAQLHETLPDGAVIHIVPRVAGAKSGGVFQIVLGAAAIAGSFFTAGATLAAWGAAIGAGGMTGILFSLGASMVLGGVAQMLAPKARTPRTQTTDNGKQNTYFSSLDNMVAQGNVLPVLYGEMRVGSRVISQEISTADEGDGGQVVVIGR

SEQ ID NO: 317 - protein, 268 aa, Escherichia coli
MGLLRKFVNGKEAAKVADVIAKLTAAQAFAAFILRDIGRRLVIFIRDRRTAITALITAIGPGAGVGQHDAPRKNSTIRFRRRGQHKGGTDRAQFAALLDAPAADHLLLRIGIAVSVDEIHRIQKTGVNLTPDHRSADQTLQIFHHPGDHTVQVRNRQRGARTGAFAIQFKTTPLNGIRLILSPLPGDRLTFFVLLITEKITFSTDLCQVDFPEHHAGRLLRTGAFIQCFLPDILHQFTTCSNSALNSTRSILTRDDHFAQVTFICRHS

SEQ ID NO: 318 - protein, 853 aa, Escherichia coli
MAEPVGDLVVDLSLDAARFDEQMARVRRHFSGTESDAKKTAAVVEQSMNRQALAAQKAGISVGQYKAAMRMLPAQFTDVATQLAGGQSPWLILLQQGGQVKDSFGGMIPMFRGLAGAITLPMVGATSLAVATGALAYAWYQGNSTLSDFNKTLVLSGNQSGLTADRMLVLSRAGQAAGLMFNQTSESLSALVKAGVSGEAQIASISQSVARFSSASGVEVDKVAEAFGKLTTDPTSGLTAMARQFHNVTAEQIAYVAQLQRSGDEAGALQAANEAATKGFDDQTRRLKENMGTLETWADRTARAFKSMWDAVLDIGRPDTAQEMLIKAEAAFKKADDIWNLRKDDYFVNDEARARYWDDREKARLALKAARKKAEQQSQQDKNAQQQSDTEASRLKYTEEAQKAYKRLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDETLEYKRQLAALGDKVTYQERLNALAQQADKFAQQQRAKRAAIEAKSRGLTDRQAEREATEQRLKEQYGDNPLALNNVMSEQKKTWAAEDQLRGSWMAGLKSGWSEWEESATDSMSQVKSAATQTFDGIAQNMAAMLTGSEQNWRSFTRSVLSMMTEILLKQAMVGIVGSIGSAIGGAVGGGASASGGTAIQAAAAKFHFATGGFTGTGGKYEPAGIVHRGEFVFTKEATSRIGVGNLYRLMRGYATGGYVGTPGSLADSRSQASGTFEQNNHVVINNDGTNGQIGPAALKAVYDMARKGARDEIQTQMRDGGLFSGGGR

SEQ ID NO: 319 - protein, 165 aa, Escherichia coli
MNQIFTVILLVLVGFVVGNVWSDRGWQKKWAERDAAELSQEVNVQFAARIIEQGRSISRDEAVKDAQQKAAEISARAADLSDSVNQLRAEATKYAIRLDAAQHTANLAAAVRGKTTKAAEGMLTNMLGDIAAEAQLYAEIADKRYIAGVTCQRIYESLRDKKYQM

SEQ ID NO: 320 - protein, 170 aa, Escherichia coli
MGAIYVKRLILSVALIIPIASNASDALNQPSSSLNDGVETFFISCFDMPQETTTDMDACQRVQLAQVSWVKNKYSVAALNRLKQDNKDDPQRLQELTASFNAESEAWTELIEKASKSVQVDYVGGTIAGTAVASRQIGLLELQSHDIWEHWLRFEDSTPPLLPEPKFKSE

SEQ ID NO: 321 - protein, 296 aa, Escherichia coli
MKNYWRATMNQNPFSFYDFLGYLIPGGFFILLMYFCGLTFDLDIVIDLSELLRGQSQIFGILNYASIVIISYIAGHFISITSAFFIEKYMNKELGYPSKYLFKKLIDTSESICSPSCDERSADKKTKIKNRIIKCVLCPIILWDFITQKLCYSQSLPFHLANTTWLMIKEGYEKKFITNRQLLQDKNGLDDDLFRLAYHYVYEFSKQHQTKIQNYVALYGFCRNICLIFIISFWVSVPTFIYRLCTHSDYLYSLLSIMLSFFFVYVFYVGFVKFYRRYTLEVLMAFAVLQSNDTIR

SEQ ID NO: 322 - protein, 131 aa, Escherichia coli
MCRAHWSAPENHVASFFHHSPAAGRRFRERRGNQTERRKTAPLPSSATANGKQVKVLFQRAVFNGMNGVEIFTKQLQVAEIVFQQLPALANFIGPCRLRRRGMGAGKHAVAVKAVIFAIEFFCVHQLRDGL

SEQ ID NO: 323 - protein, 347 aa, Escherichia coli
MLRKRNPVISSTSPAIFGIITLFIVEVPTSTPFERKTLVRISVFIASGDVENFHRHAWVGFRNPLGDSVSHHAGVIRHGVVENGDSVFLIIRRPFQVQLDNLRRVIAPYHAVRGRYHIDWQVKAQDLGNFRRYQAAERRQDIGVVTLALLEKLSLIHFIVEQMLVAVVLTESIVTEQHRVACQVSHHAVRPVQHWRFDKNELFAVADIQRVASFHHIKIPLRMMVMTIYRVDSVGCTVDRRIGNLRHQFGQRPGVVLFSMVNYDVIDICQIDFITQVLHKFAAEFMVDGVDQHVFFFADEVAVVAAAAQRFIFCTVKITHFPVTLTNPMNVIFHHNRHSNLNLFSVF

SEQ ID NO: 324 - protein, 41 aa, Escherichia coli
MADAKSPDALRLSGFERAQILNFARPCLSFRLLSLLLLIYQ

SEQ ID NO: 325 - protein, 139 aa, Escherichia coli
MTANAARAVKATRELVNAVPFLGGSDSEDDYREALELVEYLIEEDDTNPLIDFLASRIAEYENNNEKFAEFDKAVAAMPVGVALLRTLIDQHNLTYADLKNEIGSKSLVSQILSGQRSLTIPHIKALSARFGVKPEWFL

SEQ ID NO: 326 - protein, 257 aa, Escherichia coli
MNIRTGMCAFLLSLVLPAQATSFTEYLPMSDSEYAQKRALKPLLTLPYDAEQTWHFRKVGIAGVTLEKMPNEEDYWRLTAKDRAGKSWFVPVGVLQNMAGNAQFYRADLDRNGIQDLVIWRGVSGNGLAPSSFLILMTFNQQGRPCVFQVDGFYTANETGVDDLLDLQGNGHTQLLDMQFDSGYWITSLYQVKEAKWQRVHGWFGKLSYPALTRFTYTSNRKLVIKPVAGRNPQTKDLALTQRCLIKGDVLDGVNQN

SEQ ID NO: 327 - protein, 347 aa, Escherichia coli
MQGIKIYTILASSLISGSIFAQTEISTANSSTVNASYVEPSAEKIISPSDKLNNLFERNMSQPYILQKIGERTYYVQRYFYSTTFYVGDKGVLLFDAPEGRGKYLLQAIRDVTPLPVTALVYSHYHVDHIGDSPFWNDEAKKEGVNLRIIASKATAEKMQFMNSRLPVATQVLSKKDDQFKFEKQTIELHRFVKAGHTDDHSVWLLKQEKVAHSPDLLNPDQLPMMGFAVSDTLVYHDSNLRQVEMLDWKYFIGGHGNIGSHDDFKFQRQFLNDLRDTTIKVRKEESFGKFMNKTANNHADFARAQREAIIKKVTEVLRPKYGHMYGYDASMPANIEMAIRLVGSYY

SEQ ID NO: 328 - protein, 41 aa, Escherichia coli
MQILPQQSCLINILLQAGLMQKLAQIIKNKMKRRIMFSRIK

SEQ ID NO: 329 - protein, 200 aa, Escherichia coli
MFRIFIAFIFIFNLSGCGYNDIQTYDEQVNASWSEVLNQYQRRTDLIPNLVASIKGYSSHEQEVLEAVTLARSQANRASSDLQKTPGDEQKLQAWQQAQAQVTRTLGQLTIISERYPQLKAQELYQNLMVQLEGSENRIAVARGRYIKAIEQYNVTIRKFPAVLTAKVMDYTPKKNYLPDDVTAVSKAPTIDFSQNANAH

SEQ ID NO: 330 - protein, 307 aa, Escherichia coli
MLMLIKRGRSMRNFIFLIAFFCSSVFATQIPVPESPRYVNDLTGTLTNSEVNTLTNQIKALTQKKHAQLVVLVVDTTGDETIEQYATRVFDSWKPGDKDRDDGVLLLVAWQDHTVRIEIGYGLEGIITDAQSGKIIRNSIIPAFKKGDLAGGLQKGINDIESRLTGNNSATITPTDHPLPFSGWWALLVWAIILTFISARGYIKTLGVICFAAIVLAFVLPIAGFSGSWGVLTTLLCFATPFLAVAIAFTPFGKKVRDSMRDANQPSRHTRSNSSSHYSSSSSSSFDNDNFSGGGGSSGGGGASGRW

SEQ ID NO: 331 - protein, 384 aa, Escherichia coli
MRIFLLLLMLCGFQVFAERLPSVTDLTGTLTTEEQSALNQQLQTLEQQNHFQVAVLVTPTTGGKNIKLAASQRYGVYHWKPVGEKRYGEGILILVVWPEGLASMKIGHGLEQMLPPEQAAQIVRYHMQPEFEKNNLFAGLTGGIESIAQFTHIKANLSPLDALANHLFANPQLSLPCLAWTVLMIVAIIVLWRFTSRPGPGIWMISMITPTVWFFCFQDDVIIRRVSVVCFSLFFAAICWQRLAVVFNMCRVFPMMLAPKNKNAKVKKQKKTPQFRESGRNSLFVVMLIIIVGWCLVFASNKDIAFISTIIGLIDHFIGPITIAGIVLLIIVAKFTGNLKLGSGEKSNRKTGNRNAHAHSRSSSRNSFRGGGGSSGGGGSSGRW

SEQ ID NO: 332 - protein, 294 aa, Escherichia coli
MVIVMRLIFILFTLWCLPGLAQQIAVPELRQQVTDITGTLSTSEQQSLTQQLQDITHKTRAQVAVLVVPSIGDDSIEQYATRVFDNWRLGDAKRNDGILIIVAWSDRTVRIQVGYGLEEKVTDALAGNIIRSIMIPAFKKQKLAKGLELAIIALNNQLTSQHQYSSNPSESESASSSDHYYFAIFWVFAVMFFPFWFFHQGNNFCRAFKSSVCISTVYLIDLFLFSDQTFSIAVFSFFFAFTIIMVFTWLCVPQKKASGRSYHSDSGGSGGGSSGGGFSGGGGSSGGGGASGRW

SEQ ID NO: 333 - protein, 45 aa, Escherichia coli
MTALKNIYQNGHFSTPPCQECPFSAQTINTVIWFVFFMIYFLKRA

SEQ ID NO: 334 - protein, 445 aa, Escherichia coli
MKICRPLWAEGTFLSSQQFQQQARWEAFSNDSIAQLCIRHPWGIANVLFDRDALALGKLKTQAVRLRFADGTLIDSDVSDVLPLACDLRALKNDSAIVLLALPLAHGNGGNLGQGEQTERPLRYRQEWQKVQDIYGSDSEDMAVERHALSLRFAHDNNQDYITCPLARLVRDVQGNWTQDESYIPPLLAFNAHDGLVQRLDTLLLQLRAKCQRLMAMRRESNQRMADFAVADVSLFWLLNALNSAEPVLSDFLRYPAVHPELVWRELARLAGALLTFSLEHNVSAVPPYVHESPSIVFPPLFSLLSELLEASLPSRVIALDLASLPGNRWKADLHDPRLREEADFYLSVRSSLPAHQVLHQLPLVCKIGAPDDVTLLINVALNGVPLVPLTSVPAALPLRLENQYFALDMHSDAAKSMLESGCCMIYAPGTMGDLKPELFAVLRT

SEQ ID NO: 335 - protein, 221 aa, Escherichia coli
MKKETDINIDALLRDTFLTVVELRQGTTVRHGMELYRHCQRQVELVRERLKDAGFSRENVEHITYAQCALLDETVLSRSGMDDGQTIWMKDPLQSHFFNTLQAGELLYERMKQVLQEPAPAQAVLTCFHRVLLLGFRGRYQDPAAPERDQLISTLNGQVAPFGVLPETAVLNVPLSTRQHPLLHSPFFWLVTLALLLAGVWWGLHHWLNVLVDELLPQSLR

SEQ ID NO: 336 - protein, 550 aa, Escherichia coli
MRNTLKQAIVLWGMVLLLVLWSVFISPSGVLRWAGAAAIVLAVAALLIYRRRQAWTEMTGDAGLSSLPPETYRQPVVLVCGGLSAHLSTDSPVRQVSEGLYLHVPDEEQLVAQVERLLTLRPAWASQLAVAYTIMPGIHRDVAVLAGRLRRFAHSMATVRRRAGVNVPWLLWSGLSGSPLPERASSPWFICTGGEVQVATSTETTMPAQWIAQSGVQERSQRLCYLLKAESLMQWLNLNVLTALNGPEAKCPPLAMTVGLVPSLPAVDNNLWQLWITARTGLTPDIADTGTDDALPFPDALLRQLPRQSGFTPLRRACVTMLGVTTVAGIAALCLSATANRQLLRQVGDDLHRFYAVPVEEFITKARHLSVLKDDATMLDGYYREGEPLRLGLGLYPGERIRQPVLRAIRDWRPPEQKMEVTASLQVQTVRLDSMSLFDVGQARLKDGSTKVLVDALVNIRAKPGWLILVAGYTDATGDEKSNQQLSLRRAEAVRNWMLQTSDIPATCFAVQGLGESQPAATNDTPQGRAVNRRVEISLVPRSDACQDVK

SEQ ID NO: 337 - protein, 274 aa, Escherichia coli
MLKEWMIFTCSLLTLAGASLPLSGCISRGQESISEGAAFGAGILREPGATKKADTKDLNVPPPVYGPPQVIFRIDDNRYFTLENYTHCENGQTFYNNKAKNIHVKILDASGYLFKGRLFWLSTRDDFLAFPATLNTRHASCMGSNKGCMNAVIVTTDGGKRRSGVPYGSYTQNPTGATRDYDMLVMNDGFYLLRYRGGQGRFSPVILRWILSTEDSSGVVRSEDAYELFRPGEEVPSTGFYKIDLSRFYPKNNVMEMQCDRTLEPVQPSESKIQ

SEQ ID NO: 338 - protein, 658 aa, Escherichia coli
MSTNKSEPTRKVDVHLTDNGTPFAYSMTSHKNVKVRAEVQPPLQLPGLIIFVHGVNSEGEWYDYAERSLCAGLNQRLGLEGEHGLKENNYEGGFFVNSDKSEGGWEHTYEIEGSQKKWVSGPRKITKGGDGRSPVIRFYWGYRAADNETDTYAIPLKNKKGDNYYDLPPESRKAKGPWFWGGGPFQNGCNQLVSLWSKTGFNNNPSLLGVPLPFSTQVLNGERDRLLSDAPPRHYYAHAAGRLAKLIKTIRNQHPEDTVTVLSHSQGTMIALAAAAIEAPDALFVMNSPYALENEPTTYISYPIKEIISRKARSATFADIVKKVAENKTRLKQQGCDNLLAGMSSDGNSWIPEGKTHNGLPERDNHGTTWIYCNPHDRVMGSSPLRSIGWQGLPDTKDGTPHTLFKQAGDTLYVRILGRNTPCGGTPTAQTHFSNLGDGKPFWDSTTTLLQRATWPDPDSGQTLTINAPQVPEPLTAEELKNFDQDYARDEKQSGGAGYAYGQINPETKKPVDTDYRYYISLYGYFDRKMVPKKDSGYYQSGPGSKEDRVKYEKQSQEEMLEEVRTYVQRPTDHSTLPSDERFMSRVVAYDLPIGYCWHSWDKAGLEELRRQADWLESDDYYFSGKLTVPPIPPAIKQDVAEDAEQRKAEEKARLRNV

SEQ ID NO: 339 - protein, 477 aa, Escherichia coli
MGWSKPKIPTSKDVQRWSPWVCLFILFAGAFVALTYGILHSPADGLPALASGYWLPLTGRMMAGVMTALTGYLLWWEFQAYYVWCWNSRRHSALLVWQQRAHQHRYLACHVLLTSDTQLLPRLAGTSYEDNNNDPPLTLLAEEPLIPGIARFEQLCQLLINQIKASLIQHYPSGQMTVLIETSASDKERERTTLIRLWKEDELPWILDIHMSPTPLPLSDENNHLFDIDNPVLVLALHYRQPEENLPEFASALLLLPPELLKVSIRRDTVRVFRPMPLNIDAISRELTELRDMAQQPVNARYLVWHSGLTQASQQALGRVVNDLPLSLHNDIATGGIIDVDKVIAAYGPPAGWLMVATAAEMVRYGPGSHWLLQVRNKQASAVVTGNGYPAINQEYLDTTSSPYPAGSLMLAVMLNILVLWFIGRYSQEWLFSWAGVAMTLLLMIVTLPGIVFGLRSAVAHLQYPRFIQAIVRAQKE

SEQ ID NO: 340 - protein, 1112 aa, Escherichia coli
MKRVVRLLGVGLLLLVVLLLILFVLAQTTPLISAQDEHAVWLRLLITAIVICLLSMCIFFLFSFRQNEASTISLYAQPTDIKEINTEQPNYASLLTIYLRDRYGPFWRRKVRLLLVTGEPEQAEAIAPGLTGQHWLEGDHTVLIYGGRPTAEPDVTLLTALKKLRRSRPLDGIIWALTEEQSRQTAQLDKGWRGLINGGKRLGFQAPLYLWQVCDDGDYQTGRPLQSVGCLLPERCTPEQLAVMLEAQTLPLTEQGMSQLLTDNRHDFLLRLAHTLAERGIAHWQTVLKPLLAGGAFSSLRLRGLMFSPPLAAVPEAAPHAWLPSPVWAGVTGDNARGRTVGFPWLRTALMSAVCVLVIWGAGMTTSFFANRALVQETGIQTARALDTRLPLAEQLVALHTLQGELERLQYRIREGAPWYQRFGLERNQQLLAAAFPGYAQAANRLVRDVAVDHLQQQLNAFVALPPNSPQRTATGEQRYKQLKALLMTSRPEKADAAFFSTTLMADGLRYENIPEGVRQSVLPSLLTFWTANLPEHPQWKTSPPPELTGAVRKILLRQIGVRNAENTLYQNVLQQVSRNYADMTLADMTGDTLTESLFSTEQTVPGMFTRQAWEGQVREAIEQVVTARREEIDWVLSDRQQDTSADISPDTLRNRLTSRYFTDFAGSWLAFLNSIHWKKEDSLSGILDQLTLMADARQSPLIALTDTLAWQAATGRENRGLSDSLAKSAQELFNGKEKTPQQSREGDDVPVGPLDKTFTPLLRLLGDKAGGGDSQLSLQTYLTRVTRVRLKLQQVTNAPDPQEMTQQLAQTVLQGKTVDLTDTRDYGRLIAASLGEEWSGFGQALFVRPVEQSWRQVLTPAADSLNRQWQRAIVSHWNQDFAGRYPFKASQNDASLPLLAQYLRDDGRINLFIAANLSGVLKREGRYWVADAMNTQGLTVNPDFIRALNRLRDVADTAFASGDAGIHFELRAKPARDVMKTHLVIDGQELEYFNQKERWQRFNWPDEQWQPGASLSWTSTQAMERILADYRGSWSLIRLLEQAQVTPVDSSTFKVVWKAQDGLPLNYLLRVEQGKGPLALLELKNFRLPGQVFLTGKSMKDVEEYGEDADE

SEQ ID NO: 341 - protein, 545 aa, Escherichia coli
MWKSMGKTPMSELLQKLTRSCFADRDALDVARTQAALWQTWLLPVTADTPVGEDPGYHDDFLRIRDEMNKLSGADTDLICQLAESLLLTQAKDVRIATYYIWARLHRDGERGLAEGLALLTGLVERFGTQLLPSRPASRKMALEWLAGEKMLDSLARYPEVAKEDFANIVAALNLLTVSFAAWPEDQHSPSLMPLINALESRLAQSGGMNAVVPQNSSGVPAPSSPVDAPQVQTITSGRDLLDQAKVLARYLNEQPQGWLSAHRLMKTLRWDTVHELPPDVDGKTRLAPPRTESRNQLKRLYAQQNWTELLEQADLMFSTGVSHFWLDIQWYLHQALTKAGVPWDRWTAVIRQDLALLLERLPGLENLAWNDGTPFADEVTRNWIAQQVMMREDGAWLAGKAAVPTDDATNDVLALEPEALAMADSQGVEAALGWIQTRPGITTARQRLLLRLLMARVAEQYGKNEMALLLLEELDTAAQGITLTQWEPELLFEVKARQLKLLRLRAHRHADKAALARKMDALLGSLVAIDPARTAVLCDTQHKD

SEQ ID NO: 342 - protein, 934 aa, Escherichia coli
MMDDLTQRYYEAEMRYLREAGKEFAQAYPDRAAMLNLDKPGARDPYVERLFEGFAFLMGRLREKLDDDLPELTEGLVSLLWPHYLRTIPSLSVVELSTDHRQMKQSETLKEFQVLSRPIGERRTRCVYSATRDITLHPLALPDVSLQYEPDGRSVIRLRFACGPLVGDWSQIDLSRLPLYLNADSPVACALHRALTLGTQQFWLRLPGQERRVLDAHFSPMGFDDDDRLWPKGESAFSGYQLLLEYFTFREKFMFVALNGLENVIWPERITGFEIDVVLAENWPHDLPFNTDNLRLHCVPVINLFPLEADPLHLSPLENEFLLRPMRIQDGHTEIYSVDNIISSRHTGSQAYVPFSSFRHRGGMLRHDAPERYYHTRVKRGPSGLHDTWLILGGDAFDTDRMLEDETLSLSLTGTNGQLPRKALQSTLLDTPVHASQNVLRVRNLCAPTQPCYPPARDRFHWRVLSHLGSNFLSMMDNAEILRGTLALYDWTESEMNRRRLEAIVDVQHSLIQRFERGFLLRGVDIQVTLDSNGFAGEGISRCLVTAAPLFRTVCRYPLIHSTDLNSATHRKVPAMDRASQPARTGLTDRLAPDIARINFYRFCQLLEQSQQNAPLGSTDSPATDAVRFRPHPGMGFPVSELKNVERDAGNPDAPPTVRTTFLGLYGVDSPLPTAYLDYITQRHDGHDAVMAFLDIFNHRFITQYYRIWRKYNYPASFEAGAVDDISRCLLGLIGLGIPGSENHIATPVSRFLALLSVMRLPTRTAEGVTALVGLLAPLTKATVVPHDPQPVILPAPAGLSKNSRISLKTRTLLGRTGTDANSQLLLKLYTEDAAEARGWLPDGQLHSDLLVLLRVYLGWRCQARLQLTLPVSLLPAARLGKQRVQISRTGILRASFAAPATGTVTVSLGRYQGLIPAFSIRNRESMTHVSYSF

SEQ ID NO: 343 - protein, 178 aa, Escherichia coli
MFPIRFKRPALLCMAMLTVVLSGCGLIQKVVDESKSVASAVFYKQIKILHLDFFSRSALNTDAEDTPLSTMVHVWQLKTREDFDKADYDTLFMQEEKTLEKDVLAKHTVWVKPEGTASLNVPLDKETQFVAIIGQFYHPDEKSDSWRLVIKRDELEADKPRSIELMRSDLRLLPLKDK

SEQ ID NO: 344 - protein, 458 aa, Escherichia coli
MASNANFISQFVMGGDPCTYKESGELQAEMSKLTHPARPDVDWRQVEKLCLALFRQNGVELQTLVCYVLAITRRQGLAGMADGLGSLDILLQRWADFWPVQVHSRISLLSWVTEKMQQALRTLDIQYQDLPQIYRCVQHLSAIETTLQQCELWHMTKLDLLAGQFRNTALRLERLAPQGAETTITPPELPRREMNQPKKSEESPQPVFATRSVQQNDKDASPPVPSPEISRQRTWPIFMAGMVVMAGLGGTGLWGWSQLNQPDALIQRIQLSVMPLPLSLESGELAKLDVKDKALLAQDRTIAASQMQLEQLNKLPARWPLEQGYRQLRQLDALWPDNPQVRALNAQWRKQRELSALSAEALNGYAQAQSQLQRLSAQLDALDERKGRYLTGSELKTAVYGIRQSLKEPPLEELLRQLEEQKQTGEVSPTLLTQIDTRLNQLLNRYVILLDTKVEQSQ

SEQ ID NO: 345 - protein, 318 aa, Escherichia coli
MSAMKNVLVTVPSFSARCVSASKLLRENNFNLIIKNNMEHLLKSESTALRESICAVIAGKDGYQADTLSLLPGVRIISRFGTGIDNIDLRAAQQSGIVVNNAVGINSNAVAEFIIGLIFASMRNIPGSYHAMQNGYWGESHGCELQGKRIGLVGYGNIGKTLAKRLSGFDVELLAFDKQPDYQVADKAGVQFVSIEDIFMQSHVIIVLLPFSSGLENFISHKYLSMMRNGALLINVARGKLLDEGALLQVIEERNVFAALDVFSSEPLAQFSPLLHAKNIITTPHIAAATVESYQQTGIHVAQSIIDYFAGREIKNVL

SEQ ID NO: 346 - protein, 198 aa, Escherichia coli
MNNTDLIHLIKHFMHNELKAVEEVIDSPLSEFANLIKVLQSCQGKVVFIGVGKSGIIARKLAATFASTGTPSFFVHGTEAVHGDLGMVAKDDVVILISNSGETAEILATLPSLKKMGNYLISFTRSHHSSLAISCDLSVEIPVKSEADNLGLAPSCSSTVVLVVGDAVALALSELKKFTRADFGLYHPGGALGIKANS

SEQ ID NO: 347 - protein, 526 aa, Escherichia coli
MKQKKAWSFFQSLGKAFMYPIALLSVCGMMLGLGSGLASDDMAKLIPFLAIPIIKTILDFIVSLGLFAFVNLPVLFAIAIPLGLLKDKEDKAYGAFSGLIGFMAMHLGTNFYLKQHDLLVVADQMSTHGQTIILGIQSYNTSVLGGIVAGLLVASMYKKIVNLRIPESLGFYSGPRLVPIITLIVMSGFGLIIPFIWPPFFNLFMLIGHWISTSGPVGYFFYAVAERVTIPFGLNHLVTSVFRFTPIGGSAVIGGEEYYGTLNMFMAYVKENAVIPLDLAGKMEQGKLMIQYGLAGAALAMYRTAHAQNRKAIKALLISGVLTVIIGGVSEPIEFLFLFVSPLLFVFHAFMNGFANMVLPYMGVKMGFTGDLIQFISFGVLRGTRTGWPIAVCVEVAYFFIYYFVFRWTILKFNLMTVGREESSPVTLNAHEDTAIADIPTPDKSELQAAEQMVKALGGKENIKSLDNCVTRLRLTIADMGLLDEAAIKRAGGIAVVKLDQNTLQVIIGTKVIALRRDMDNYMGIY

SEQ ID NO: 348 - protein, 49 aa, Escherichia coli
MPRIFDLVFFDIFLVLNVVLFKLTFSSIYLYIEICSFFGFLFCYDFGVF

SEQ ID NO: 349 - protein, 351 aa, Escherichia coli
MSNVQEWQQLANKELSRREKTVDSLVQQTAEGIAIKPLYTEADLDNLEVTGTLPGLPPYVRGPRATMYTAQPWTIRQYAGFSTAKESNAFYRRNLAAHRGYDSDNPRVAGDVGKAGVAIDTGEDMKVLFDQIPLDKMSVSMTMNGAVLPVLAFYIVAAEEQGVTSDKLTGTIQNDILKEYLCRNTYIYPPKPSMRIIADIIAWCSGNMPRFNTISISSYHMGEAGANCVQQVAFTLADRIEYIKAAISAGLKIDGFVPRLSFFFGIGMDLFMNAAMLRAARYLWSEAVSGFGAQDPYNNVIRTTIDHCAHPMCRDYLHRYLENASGGHIHHDLSHVFDLHRNLIATGSMLG

SEQ ID NO: 350 - protein, 192 aa, Escherichia coli
MARRHFSSQALVLIVISIAINMIGGQLASMVKLPIFLDSIGTLISAVLLGPVIGMLTGLLTNLLWGLLTDPIAAAFAPVAMVIGLVAGWLARAGWFRTLPKVVVSGVIITLAVTVVAVPLRTALFGGVTGSGADLFVAWMHSMGQNLVESVAITVIGANLVDKILTAVIVWLLLRQLPIRTTRHFPAMAAVR

SEQ ID NO: 351 - protein, 235 aa, Escherichia coli
MHPFTSLTLWALAACTTLILPTQTILPVYSAATFFCLIAPKATRRRAKYVVWLMFSLGAGLWLVHGGWLTEWLSGTPRSPERWAHAITLWLRILAIVSTSQLWMQYVPVQRFIRALFASRLPPGVAYLFAGPLLVVEQLKRQLAIIHEAQRARGVPLDEGWYQRLRAMPALIIPLTHNALNDLAVRGAALDMRAFRINNRRTTLWAPADSTLQRVARYAMILLMLAEFGAWIWLR

SEQ ID NO: 352 - protein, 236 aa, Escherichia coli
MAIAKRSAPATMLTLNQISYRWPGAATDCLCDISLQLKQGEWLALTGDNGAGKSTLLRVMAGLLTPTAGTVMLQQQAMKNLKNRQRAAKIGVLFQEAENQLFHSTVADEIAFGLILQKCPADEITQRTNAALQCCQLADTASAHPLDLHSAQRRMVAVACLEALSPPLLLLDEPSRDFDENWLSVFESWLEKCRQRGTSVVAISHDAAFTRRHFSRVVRLEDGVIRNVNPSDDIHP

SEQ ID NO: 353 - protein, 244 aa, Escherichia coli
MSVFSSPHVTYSPLYSRKIHMKAPVSLTSFRPQKSLAIAIGVLAVVVLPFLSYYTVNEGERGILLRYGKIVKVAEPGLGFKIPFMESVEKISTRNQAVVYQGLQAYSRDQQPAQMTVSVSFHIKPSEAGAVYTTYNTIEALKDRLIVRQLPTQLENVFGQYTAISAVQDRTKLVQDLQNAMRKAVVGPVVIDGVQIENIDFSDAYEKSIEDRMKAEVAIPRVSKSGNGENPGAIRYSGPGGSRQ

SEQ ID NO: 354 - protein, 152 aa, Escherichia coli
MRRAANAALQIVGKVRVVYAGCGVNALSVLQDFANSTYCRKYVGLISVAHQAVLSLLSVSRAAKAALFYLVEINGTVLPGIMVSGSLPSQRSAVVRATSPGFSRRASPRRRIASASAALFKRIVSASAAPLTRIVSASALAAASLLSASAWA

SEQ ID NO: 355 - protein, 243 aa, Escherichia coli
MKKWKVRSALVALIVLLAGCSSNAQYNSSASGNVGTAWGGDVHSTVQGVSAERAWRDPAEMIVISYSTNVPSGYDRVYSIRINELEYAIRDGNFNSLPITRVYDSSNNEPRYIVHARVGMNYQLYVRNYSRNTNYEIVATVDGLDVLNGKQGSLNNNGYIVNAGDSLAIKGFRKDKHTEAAFQFANVADSYAANSAQGDVRNTGVIGFAAFELQGPAKNALPPCSGQAFPADNNGYAPPPCRK

SEQ ID NO: 356 - protein, 72 aa, Escherichia coli
MNYPMDSLTPFHDALLSNTLWLTSKKTGFPLLAGNHLPGVFGWSGYSCLVISKIIAINSGKLIVHNLVMIFP

SEQ ID NO: 357 - protein, 490 aa, Escherichia coli
MNCSLTLSQRLSLVFTVVLLFCAAVTCGVHIYSSNLYGNAMVQRLSAGLAQQIVITEPLLDNRGQVNHRTLKSLFERLMTLNPSVELYIVSPEGRLLVEAAPLGHIKRRYINIAPLKKFLSGAVWPVYGDDPRSVNKKKVFSTAPLYLRDDLKGYLYIILQGEELNALTDAAWTKALWNALYWSLFLVVICGLLSGMLVWYWVTRPIQQLTENVSGIEQDSISAIKQLAIQRPATPPSNEVEILHNAFIELARKISCQWDQLSESDQQRREFIANISHDLRTPLTSLLGYLETLSMKSDSLSSEDCHKYLTTALRQGHKVRHLSCQLFELARLEHGAIKPQLEQFSVCELIQDVAQKFELSIETRRLQLRIMMSHSLPLIRADISMIERVITNLLDNAVRHTPPEGSIRLKVWQEDNRLHVEVADSGPGLTEDMRTHLFRRASVLCHEPSEEPRGGLGLLIVRRMLVLHGGDIRLTDSTTGACFRFFLPL

SEQ ID NO: 358 - protein, 131 aa, Escherichia coli
MQPLPLKQIHPLWLRCCHRINAVTVAGMICSGWRIYNASPLFSFNYPAALTLGGWLGGALLWHFALMWILLINATIYLTLGICSGRFRSKFFPLSWTSLKESLTQALYGKLHHTNMQEYNMVQKVAYILLF

SEQ ID NO: 359 - protein, 80 aa, Escherichia coli
MKNIISVTVLSALFMFNAQAADTMDKTHEVKGSMSSAHDKMCKDGMCKNAMDKEKMEKEHMSKTDGMKNDHMGKKDNMSQ

SEQ ID NO: 360 - protein, 224 aa, Escherichia coli
MVCFFLPATAMNAFFMLMCVMKLNARNIFKGLISFSHRLRLLIQEYNLIYSELIMNMNNPLEVLGHVSWLWASSPLHRNWPVSLFAINVLPAIRANQYALLTRDNYPVAYCSWANLSLENEIKYLNDVTSLVAEDWTSGDRKWFIDWIAPFGDNGALYKYMRKKFPDELFRAIRVDPKTHVGKVSEFHGGKIDKQLANKIFKQYYHELITEVKNKTDFNFSLTG

SEQ ID NO: 361 - protein, 1024 aa, Escherichia coli
MPTITTAQIKSTLQSAKQSSANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKRQKSGSNVSSSELAKASIELINQLVDTAASINNNVNSFSQQLNKLGSVLSNTKHLTGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKILQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 362 - protein, 707 aa, Escherichia coli
MDSCHKIDYGLYALEILAQYHNVSVNPEEIKHRFDTDGTGLGLTSWLLAAKSLELKVKQVKKTIDRLNFISLPALVWREDGRHFILTKVSKEANRYLIFDLEQRNPRVLEQSEFEALYQGHIILIASRSSVTGKLAKFDFTWFIPAIIKYRKIFIETLVVSVFLQLFALITPLFFQVVMDKVLVHRGFSTLNVITVALSVVVVFEIILSGLRTYIFAHSTSRIDVELGAKLFRHLLALPISYFESRRVGDTVARVRELDQIRNFLTGQALTSVLDLLFSFIFFAVMWYYSPKLTLVILFSLPCYAAWSVFISPILRRRLDDKFSRNADNQSFLVESVTAINTIKAMAVSPQMTNIWDKQLAGYVAAGFKVTVLATIGQQGIQLIQKTVMIINLWLGAHLVISGDLSIGQLIAFNMLAGQIVAPVIRLAQIWQDFQQVGISVTRLGDVLNSPTESYHGKLALPEINGNITFRNIRFRYKPDSPVILDNINLSIKQGEVIGIVGRSGSGKSTLTKLIQRFYIPENGQVLIDGHDLALADPNWLRRQVGVVLQDNVLLNRSIIDNISLANPGMSVEKVIYAAKLAGAHDFISELREGYNTIVGEQGAGLSGGQRQRIAIARALVNNPKILIFDEATSALDYESEHIIMRNMHKICKGRTVIIIAHRLSTVKNADRIIVMEKGKIVEQGKHKELLSEPESLYSYLYQLQSD

SEQ ID NO: 363 - protein, 478 aa, Escherichia coli
MKTWLMGFSEFLLRYKLVWSETWKIRKQLDTPVREKDENEFLPAHLELIETPVSRRPRLVAYFIMGFLVIAVILSVLGQVEIVATANGKLTLSGRSKEIKPIENSIVKEIIVKEGESVRKGDVLLKLTALGAEADTLKTQSSLLQTRLEQTRYQILSRSIELNKLPELKLPDEPYFQNVSEEEVLRLTSLIKEQFSTWQNQKYQKELNLDKKRAERLTILARINRYENLSRVEKSRLDDFRSLLHKQAIAKHAVLEQENKYVEAANELRVYKSQLEQIESEILSAKEEYQLVTQLFKNEILDKLRQTTDNIELLTLELEKNEERQQASVIRAPVSGKVQQLKVHTEGGVVTTAETLMVIVPEDDTLEVTALVQNKDIGFINVGQNAIIKVEAFPYTRYGYLVGKVKNINLDAIEDQKLGLVFNVIVSVEENDLSTGNKHIPLSSGMAVTAEIKTGMRSVISYLLSPLEESVTESLHER

SEQ ID NO: 364 - protein, 336 aa, Escherichia coli
MKKWFPALLFSLCVSGESSAWNNIVFYSLGNVNSYQGGNVVITQRPQFITSWRPGIATVTWNQCNGPEFADGSWAYYREYIAWVVFPKKVMTKNGYPLFIEVHNKGSWSEENTGDNDSYFFLKGYKWDERAFDAGNLCQKPGETTRLTEKFNDIIFKVALPADLPLGDYSVTIPYTSGIQRHFASYLGARFKIPYNVAKTLPRENEMLFLFKNIGGCRPSAQSLEIKHGDLSINSANNHYAAQTLSVSCDVPANIRFMLLRNTTPTYSHGKKFSVGLGHGWDSIVSVNGVDTGETTMRWYKAGTQNLTIGSRLYGESSKIQPGVLSGSATLLMILP

SEQ ID NO: 365 - protein, 176 aa, Escherichia coli
MFSVPLSGGGMARLSLFISLLLTSVAVLADVQINIRGNVYIPPCTINNGQNIVVDFGNINPEHVDNSRGEVTKTISISCTYKSGSPWIKVTGNAMAGQTNVLATNIANFGIALYQGKGMSTPLTLGNGSGNGYRVTAGLDTARSTFTFTSVPFRNGSRTLNGGDFRTTASMSMIYN

SEQ ID NO: 366 - protein, 179 aa, Escherichia coli
MYRIFQMKKIRGLCLPVMLGAVLMSQHVHAADNLTFKGKLIIPACTVTKAEVDWGNVEIQTLSQNGNHEKEFTVNMQCPYHLGTMKVTITATNTYNNAILVQNTSNTSSDGVLVYLYNSNAGNIGTAITLGTPFTPGKITGNNADRTISLHAKLGYKGNMQSLKAGDFSATATLVASYS

SEQ ID NO: 367 - protein, 179 aa, Escherichia coli
MMIKSTGALLLFAALSAGQAIASDVAFRGNLLDRPCHVSGDSLNKHVVFKTRASRDFWYPPGRSPTESFVIRLENCHATAVGKIVTLTFKGTEEAALPGHLKVTGVNAGRLGIALLDTDGSSLLKPGTSHNKGQGEKVTGNSLELPFGAYVVATPEALRTKSVVPGDYEATATFELTYR

SEQ ID NO: 368 - protein, 193 aa, Escherichia coli
MVVNKTTAVLYLIALSLSGFIHTFLRAEERGIYDDVFTADELHHYRINERGGRTGSLAVSGALLSSPCTLVSNEVPLSLRPENHSAAAGAPLMLRLAGCGDGGALLPGKRGVAMTVSGSLVTGHGTGSALLPDRKLSGCDHLVIHDGDTFLLCRPDRRQEDMLAAWRKRAAQEGEYSDARSNPAMLRLSIKYE

SEQ ID NO: 369 - protein, 840 aa, Escherichia coli
MMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 370 - protein, 195 aa, Escherichia coli
MRLRFSVPLFFFCCVFVHGVFAGPFPPPGMSLPEYWGEEHVWWDGRAAFHGEVVRPACTLAMEDAWQIIDMGETPVRDLQNGFSGPERKFSLRLRNCEFNSQGGNLFSDSRIRVTFDGVRGETPDKFNLSGQAKGINLQIADARGNIARAGKVMPAIPLTGNEEALDYTLRIVRNGKKLEAGNYFAVLGFRVDYE

SEQ ID NO: 371 - protein, 199 aa, Escherichia coli
MCSVMKKRLLFMIKSVIAGAVAMAVVSFGAYAAPTIPQGQGKVTFNGTVVDAPCGIDAQSADQSIDFGQVSKLFLENDGESQPKSFDIKLINCDITNFKKAAGGGGAKTGTVSLTFSGVPSGPQSDMLQTVGATNTAIVVTDPHGKRVKFDGATATGVSYLVDGDNTIHFTAAVRKDGSGNPVTEGAFSAVANFNLTYQ

SEQ ID NO: 372 - protein, 172 aa, Escherichia coli
MAERPDQLWVADFNYVSTWQGFVYVAFIIDVFAGYIVGWWVSSSMETTFMLDALEQALWARRPSGTIHHSDKGSQYVSLAYMERLKEAKLLASTGSTGDSYDNAMAESINGLYKAEVIHRKIWKNRAEVELATLTWVDWYNNRRLLGRLGHTPPAEAEKAYYASIGNNDLAA

SEQ ID NO: 373 - protein, 53 aa, Escherichia coli
MQRNAHDALVVIGFCRRTVVFHGDKQRVRFAIRLISLVLTMWMRSPLKKAIVI

SEQ ID NO: 374 - protein, 86 aa, Escherichia coli
MNYVICTTIVALGLILTGYATAADEINRQDVVGLMPSDYISVGNLYTPEEVATALKDKAEQAGGSHFRITSLGGKNKLDGTAIIYR

SEQ ID NO: 375 - protein, 152 aa, Escherichia coli
MHIIFHPENEMKKFINVYIKSDYDIVILRLSVIIIFMLFGTYKWFDFEVMALKPLISPTWLNILYIMFGVHGGSYFLGIVETITFLALSIGFFRPAAGILGDIIVIVTGLVTLSLLPQLGKVDSFVIKDVLLLGAGSVLLKYDLKNHLNIKN

SEQ ID NO: 376 - protein, 71 aa, Escherichia coli
MWLLIFWLSSPFNVSSGDARQPTLAVHSQAFHTERACRDALRAIKKENVGEFSLRGVCVSDGNTKEEAESS

SEQ ID NO: 377 - protein, 106 aa, Escherichia coli
MHISVFWVTCIVLFSEMQNNKKQGHIMKDEIHSTSINPDVVEQFLALMNTHCKSSEEALAMLSTLCYNLMMTCGIHSMDSQMLNGHGISMQLQGIDIAERPGKNIH

SEQ ID NO: 378 - protein, 74 aa, Escherichia coli
MTFQGNNSFMRLAGQVLITLITWRSHVSGSIPLSFAATDQAVHHCRTIARHLKVRSRQQEGIILSRHFSGGPVR

SEQ ID NO: 379 - protein, 696 aa, Escherichia coli
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 380 - protein, 124 aa, Escherichia coli
MIVLILVFRLVIGEQMIDVLGPEKRRRRTTQEKIAIVQQSFEPGMTVSLVARQHGVAASQLFLWRKQYQEGSLSAVAAGEQVVPASELAAAMKQIKELQRLLGKKRWKMNSLKKPLNMGVQKSG

SEQ ID NO: 381 - protein, 232 aa, Escherichia coli
MRNRHLVNTTWITRSTPTSVTLSDNSPGRVCGPSSTGENMYYPVTDYIALALIISFLFLTLFICLLCLKHERIKKETIRQKNAHILDHGWNATEFSWFRYGQYNETGIYISIEKTIIITITVSGGCFKKEYSIVSHMLVTNTITEATLYENGLYTRHIRLSRPVSDSKYPLPPGSQLIKNMTLRLRLQDQQEETSVTLFQGKMSTDGNNYSIIKGKVSSVLLLLKMLQINHA

SEQ ID NO: 382 - protein, 1299 aa, Escherichia coli
MREYMNKIYSLKYSAATGGLIAVSELAKRVSGKTNRKLVATMLSLAVAGTVNAANIDISNVWARDYLDLAQNKGIFQPGATDVTITLKNGDKFSFHNLSIPDFSGAAASGAATAIGGSYSVTVAHNKKNPQAAETQVYAQSSYRVVDRRNSNDFEIQRLNKFVVETVGATPAETNPTTYSDALERYGIVTSDGSKKIIGFRAGSGGTSFINGESKISTNSAYSHDLLSASLFEVTQWDSYGMMIYKNDKTFRNLEIFGDSGSGAYLYDNKLEKWVLVGTTHGIASVNGDQLTWITKYNDKLVSELKDTYSHKINLNGNNVTIKNTDITLHQNNADTTGTQEKITKDKDIVFTNGGDVLFKDNLDFGSGGIIFDEGHEYNINGQGFTFKGAGIDIGKESIVNWNALYSSDDVLHKIGPGTLNVQKKQGANIKIGEGNVILNEEGTFNNIYLASGNGKVILNKDNSLGNDQYAGIFFTKRGGTLDLNGHNQTFTRIAATDDGTTITNSDTTKEAVLAINNEDSYIYHGNINGNIKLTHNINSQDKKTNAKLILDGSVNTKNDVEVSNASLTMQGHATEHAIFRSSANHCSLVFLCGTDWVTVLKETESSYNKKFNSDYKSNNQQTSFDQPDWKTGVFKFDTLHLNNADFSISRNANVEGNISANKSAITIGDKNVYIDNLAGKNITNNGFDFKQTISTNLSIGETKFTGGITAHNSQIAIGDQAVVTLNGATFLDNTPISIDKGAKVIAQNSMFTTKGIDISGELTMMGIPEQNSKTVTPGLHYAADGFRLSGGNANFIARNMASVTGNIYADDAATITLGQPETETPTISSAYQAWAETLLYGFDTAYRGAITAPKATVSMNNAIWHLNSQSSINRLETKDSMVRFTGDNGKFTTLTVNNLTIDDSAFVLRANLAQADQLVVNKSLSGKNNLLLVDFIEKNGNSNGLNIDLVSAPKGTAVDVFKATTRSIGFSDVTPVIEQKNDTDKATWTLIGYKSVANADAAKKATLLMSGGYKAFLAEVNNLNKRMGDLRDINGESGAWARIISGTGSAGGGFSDNYTHVQVGADNKHELDGLDLFTGVTMTYTDSHAGSDAFSGETKSVGAGLYASAMFESGAYIDLIGKYVHHDNEYTATFAGLGTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNLRFGLEFEKSAFGKYNVDNAINANFRYSF

SEQ ID NO: 383 - protein, 47 aa, Escherichia coli
MAFVKDNTTATKIQIILKQDISPICEHNIFVFSYFFLSTSGICIVLV

SEQ ID NO: 384 - protein, 445 aa, Escherichia coli
MKKSVDFIGVGTGPFNLSIAALSHQIEELNCLFFDEHPHFSWHPGMLVPDCHMQTVFLKDLVSAVAPTNPYSFVNYLVKHKKFYRFLTSRLRTVSREEFSDYLRWAAEDMNNLYFSHTVENIDFDKKSRLFLVQTSRGEYFARNICLGTGKQPYLPPCVKHVTQSCFHASEMNLRRPDLSGKRITVVGGGQSGADLFLNALRGEWGEAAEINWVSRRNNFNALDEAAFADEYFTPEYISGFSGLKEDIRHQLLDEQKMTSDGITADSLLTIYRELYHRFEVLRKPRNIRLLPSRSVTTLESSGPGWKLLMEHHLDRGRESLESDVVIFATGYRSALPQILPSLMPLITMHDKNTFKVRDDFTLEWSGPKENNIFAVNASMQTHGIAEPQLSLMAWRSARILNRVLGRDLFDLSMPPALIQWRSGSRKKPQPEAAALTHYTTNIQE

SEQ ID NO: 385 - protein, 580 aa, Escherichia coli
MNHKDWDFVNRRLVAKMLSEMEYEQVFHAESQGDDHYCINLPGAQWRFIAERGIWGWLWIDAQTLRCTDEPVLAQTLLMQLKPVLSMSDATVAEHMQDLYATLLGDLQLLKARRGLSASDLINLDADRLQCLLSGHPKFVFNKGRRGWGKEALERYAPEYANTFRLHWLAVKREHMIWRCDNDLDIQQLLTAAMDPQEFTRFSQVWQENGLDHNWLPLPVHPWQWQQKIATDFIADFAEGRMVSLGEFGDQWLAQQSLRTLTNASRRGGLDIKLPLTIYNTSCYRGIPGRYIAAGPLASRWLQQVFATDATLVQSGAVILGEPAAGYVSHEGYAALARAPYRYQEMLGVIWRENPCRWLKPDESPVLMATLMECDENNQPLAGAYIDRSGLDAETWLTQLFRVVVVPLYHLLCRYGVALIAHGQNITLAMKEGVPQRVLLKDFQGDMRLVKEAFPEMDSLPQEVRDVTSRLSADYLIHDLQTGHFVTVLRFISPLMVRLGVPERRFYQLLAAVLSDYMNKHPQMSERFALFSLFRPQIIRVVLNPVKLTWPDQDGGSRMLPNYLENLQNPLWLVTQEYES

SEQ ID NO: 386 - protein, 595 aa, Escherichia coli
MIMRIIIDIIVIILLCGSCLTMTLPSEKPATDVAAQCFLNALIRETTDWKLTEYPPDELIIPLDEQKSLHFRVAYFSPTQHHRFAFPARLVTASGSYPVDFTTLSRLIIDKLRHQLFLPVPLCETFHQRVLESHAHTQQAIDARHDWTALREKALNFGEAEQALLTGHAFHPAPKSHEPFNRREAERYLPDMAPHFPLRWFSVDKTQIAGESLHLNLQQRLTRFAAENAPQLLNELSDNQWLFPLHPWQGEYLLQQGWCQALVAKGLIKDLGEAGTSWLPTTSSRSLYCATSRDMIKFSLSVRLTNSIRTLSVKEVKRGMRLARLAQTDGWQMLQVRFPTFRVMQEDGWAGLLDLNGNIMQESLFALRENLLVDQPKSQTNVLVSLTQAAPDGGDSLLVSAVKRLSDRLGITVQQAAHAWVDAYCQQVLKPLFTAEADYGLVLLAHQQNILVQMLGDLPVGFIYRDCQGSAFMPHATDWLDSIGEAQAENIFTHEQLLRYFPYYLLVNSTFAVTAALGAAGLDSESNLMARVRASLAEVRDQVTHKTCLNYVLESPYWNVKGNFFCYLNDHNENTIVDPSVIYFDFANPLQAQEV

SEQ ID NO: 387 - protein, 397 aa, Escherichia coli
MSPGIEDTPQKPLSCWPLAFSAGLLGIGQNGLLVVLPVLVIQTNLSLSVWAALLMLGSMLFLPSSPWWGKQISRTGSKPVVLWALGGYGISFTLLGLGSVLMATSAITTAVGLGILIIARIAYGLTVSAMVPACQVWALQRAGEGNRMAALATISSGLSCGRLFGPLCAAAMLAIHPLAPLGLLMAAPVLALLMLLRLPGTPPQPTPEYKSVSLKRDCLPYLLCAILLAAAVSMMQLGLSPALTRQFATDTTAISQQVAWLLGLSAVAALIAQFGVLRPQRLTPVALLLSAGVLMSGGLAIMLSEQLWLFYPGCAVLSFGAALATPAYQLLLNDKLADGAGAGWLATSHTLGYGLCALLVPLVSKTGVAIALIMAALFATILFTIVSVFIWHYRTIK

SEQ ID NO: 388 - protein, 329 aa, Escherichia coli
MMYHHDFNEKIGFWYVIALAGQSNGMAYGEGIPLPDTLDKPESRVKQLARRKTITPGGKECKFNEIIPADHCLHDVQDMSGYHHPAADLHKGEYGCVGQGLHIAKKLLPYIPEQAGILLVPCCRGGAAFTVGAEGMYVPDTGATADAMRWGTGTALYEDLVARVKVALEYNRKNKLLSVCWMQGEFDLMSPDYEKHPDLFYQMVTSFRSELSEYSSQCVGNSSERVPWLCGDTTWYWKESYQKEYDFIYGHYRQRTDDEIHFLSFQDSNRHELTNEPEEDADDLSVGYLGSSWRTELSWTTSQRSTHFNSMARRGVIAECYAQKIRNYL

SEQ ID NO: 389 - protein, 372 aa, Escherichia coli
MITMKVKNFIYLPFCLFIGTSVAGALPEIPEPFKYGVGGIENGKIYIGLGSLGNNWYMIDTNQSEKKWTKIAQWPTVPREQATATIIDGKIYVFGGIGKDTSGVITLQKDVYSYDIAKDKWEKLMTRPPVSLAGHVSFIHNGHAVSTGGVNENIFNGYFSDVELSKGNSALTEKVNRDYFSKPADDYFLNNHIISYDPSKNQWKNLGTTPFPGTAGSSVIFAEQQIYILGGERKPGLRSVRSWTGELSHDRIKWSELPPVASPEGVSGAYASVIDGNIFLAGGAYFPGAAEKYSNGEYWSHKGLDKAYSKEIYQLIKNDWKKVGSLPEGLAYGVSLPWQGGMLILGGEKKDGKAVSDVIYLKKNDKQIKIVK

SEQ ID NO: 390 - protein, 246 aa, Escherichia coli
MINIFNDEAFMKKYYPLLTVILLGLPLCSQALTLNLRGGYRSASHAYETLIQVSQGWNNGWWASFESNTWNTIHNNENELFALNYNKIDINKTYKIDDKWALIPGIQTQWMSAGSQYNPYLKISYQATPDLNLALRYRYDWKAFRQTDLDGNRARNDQHQFDGYVTYKINDSWLFAWQTTVYTKVNNFKYGNHKKTATENAFVLQYKMSPVFTPYIEYDYLDKQGVYKGKDNKHENSYRVGVLINF

SEQ ID NO: 391 - protein, 269 aa, Escherichia coli
MIHYRENIYSLDNYERYITDSSLFENTGDGIIYTGIVPLITVVEPVVSNQHSVLIIPGGGYRRIVYEREGLDVGRWIAGQGYTAFILSYRMPSVNGYYSFADAKNALNFISYWAGMSERTFKSVGCMGFSAGGHLAGYITHLHYEEETSVRPDWMALIYPVISLDRSIAHQGCRKRLLDAGESEYSASLENSVTEYMPPVFIVHATDDKDVPVIHSLRYFNSIRDKGHHAEAHFFDKGGHGFGVSGKNGYPIEKWQSLLLEWLAEHKFY

SEQ ID NO: 392 - protein, 502 aa, Escherichia coli
MYYKSAIIVRFNMDSCIQKKQVWYKHLSPRQWKIFGAAWTGYLLDGFDFVLISLVLTEVQHEFGLTTIEAASLISAAFISRWFGGLAIGALSDKMGRRMAMVLSIVLFSLGTLACGLAPGYAVMFIARIVIGLGMAGEYGSSVTYVIESWPVHLRNKASGFLISGFSIGGGLAAQVYSIVVPLWGWRSLFFVGMLPILFAFYLRKNLPESDDWQKRQQENKPVRTMVDILYREKNKYINILLSCIAFACLYVCFSGVTANAALITVMALCCAAVFISFIYQGMGKRWPTGIMLMLVVMFCFLYGWPLQAFLPTWLKVDMQYSPETVALIFMLAGFGSAAGSCIGGFMGDWLGTRKAYVISLLIGQLVIIPVFLVDRDYVWLLGLLIFTQQVFGQGIGALVPKIISGYFNVEQRAAGLGFIYNVGSLGGACAPILGAVVASHTSLGTAMCSLAFILTFVVLVLIGFDMPSRVQRWIHPEAALEYDTVDGKPFYGARKKNVAEE

SEQ ID NO: 393 - protein, 291 aa, Escherichia coli
MITLAVDIGGTKISAALISDDGSFLLKKQISTPHERCPDEMTGALRLLVSEMKGTAERFAVASTGIINNGVLTALNPDNLGGLKEYPLKNIMEDITGLNGSVINDAQAAAWAEYTVLPKEICDMVFITVSTGVGGGIVVNRKLLTGVSGLAGHVGHILSGVTDTECGCGRRGCVEAVSSGRAIMGAAKNKLAGYSTKYIFELARQGYKEAEFLTERSASTIAELIVSLKLLLDCQVVVVGGSVGLADGYVQKVSKHLSIYSEICNVMLFPAYFRSDSGLIGATLWDRDCIT

SEQ ID NO: 394 - protein, 502 aa, Escherichia coli
MCCEVIMPYFQYPDEFPLSSLPPLIRDAVIEAQQITQAPLGLVAASALGAVSLVCQNLIDVCRLNTLRGPVSLFLLTLAESGERKTAVDKLLMEPLYQQEMLLYSRHKNELTTWKNKEELLKAQKKALLSKLNKELRKGADESETLRQLEALQKNRGEKPVRYKFIFNDATTAAIKDQLCGQWRSVGIMSDEAGIIFDGYTLSELPFINKMWDGSVLSVDRKNEPEQMIENARMTLSLMVQPGLFDRYMERKGSVARDSGFLARCLISKPATTQGKRFINGAVTPGGSLTAFHERLMELARGSIEKSSKDERYCLHFSPEAQKIFIDHYNVLEQDLSPSGPLSQFRGHVSKKTENIARIAALLQYFSQGEGKISADIMTSAVVISSWYTDEYKKLFALPDESELQLQDARELLDWLIEECRGECPPRVRKNYILQCGPGRFRNRKKLNVLLNILASQLRLSVVQEGKTTYVLLSEINNITLPELNACYSQKLIRWHEQSFGL

SEQ ID NO: 395 - protein, 151 aa, Escherichia coli; identical to SEQ ID NO: 138

SEQ ID NO: 396 - protein, 242 aa, Escherichia coli
MAVTSPVTDFSLKLPEVTFLHRLQGISNTMKLTLLRCMLPDSPGCCRLPVPASFKTGSVPLAAESAEPDARLFHKPAIAEPENALAEVNPENATDLPEVFIHVFIPVAVSMMLTVPVAGFSPCRAGKFIQRIHCDGDNAAHQNAFTDSVQSDAHQPDIRAKTVLTTFSKHGQHTGNILHFTTGIRFSAAVPAVFAGTEREKTGCRMLLVNTHGFTTSDNFHNGIPLKTEDKSENRCDVVVTG

SEQ ID NO: 397 - protein, 51 aa, Escherichia coli
MAALVVTWFNPVKEAFYMHLPAPGKTKKVALVDCMRKLLTILNAMLRKNEE

SEQ ID NO: 398 - protein, 47 aa, Escherichia coli
MSDMIVVVLIISGNECGIKSGRIVFLLYLFFRRLLLNRKITMVIISG

SEQ ID NO: 399 - protein, 382 aa, Escherichia coli
MLIKVKSAVSWMRARLSAISLADIQKHLAKIIILAPMAVLLIYLAIFSQPRYMSESKVAIKRSDDLNSGSLNFGLLLGASNPSSAEDALYLKEYINSPDMLAALDKQLNFREAFSHSGLDFLNHLSKDETAEGFLKYYKDRINVSYDDKTGLLNIQTQGFSPEFALKFNQTVLKESERFINEMSHRIARDQLAFAETEMEKARQRLDASKAELLSYQDNNNVLDPQAQAQAASTLVNTLMGQKIQMEADLRNLLTYLREDAPQVVSARNAIQSLQAQIDEEKSKITAPQGDKLNRMAVDFEEIKSKVEFNTELYKLTLTSIEKTRVEAARKLKVLSVISSPQLPQESSFPNIPYLIACWLLVCCLLFGTLKLLLAVIEDHRD

SEQ ID NO: 400 - protein, 559 aa, Escherichia coli
MMKLFKSILLIAACHAAQASAVIDINADPNLTGAAPLTGILNGQKSDTQNMSGFDNTPPPAPPVVMSRMFGAQLFNGTSADSGATVGFNPDYILNPGDSIQVRLWGAFTFDGALQVDPKGNIFLPNVGPVKVAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGAAVNAEDVDSLKPGDEIMVLPKYESKNIEVTRGISTILYQLAVGAKVILSL

SEQ ID NO: 401 - protein, 331 aa, Escherichia coli
MALRLNSVFILAVICSIQICSAAILSKSYSHNDIHITLPLLFNEYDDVLSQYDGAKYLYPSSFALDDDNNIYIQYIFEPKQKDNILVCYNKKGNYLGYYKIPSGGRGGAGEGLAIIQDYNGFNVVYVVSNTGTLQRYNMVSSLYGDRLFKERDFSINAFNQFSMSQDYWLIEGYESERSIKYSRNRLELYSVSGDLLRVIYLQNNYSGYIVSDASPDAKNYNKRQGIALGDGFFVASYGAFYYSKMESTYNTYQGIRVFDFSGKLLSEKIFHPNEMMNVLKKMGLTVSRIENEGVIVKNNTIYSMYIYSDRYHHKTSRSEGIIILLDEFTQ

SEQ ID NO: 402 - protein, 342 aa, Escherichia coli
MNKTVLHINSNITTDEISLLLQASKYKYIHFEIIGKGDSCKNLIEFSYHDYNLKKQLIALTNAGFMSYVHRGNVTSLVHFDEIKNLWIPVKEKKFSINSDGIVYTLQRAACKINEKLLIVFSQMPIEPYSASLYRYFAKNFSTIDKYIGKNVSILRVADIGGITGSFYLNTNALPTNADKIKSLILEVIEQCQIKSDDVVLYGCSKGGTAAVYHGLTNNYKIVAVDPILNDEHYINNKNDLHLIEGVFPQPKEELFKKVIDDYLINYKGNMSYFIVSQNSEQYKYIMDIINPIITYSTVANSINDKIKSHPDVGPQSIHMIVAMINMALSGIKLSNGIYDFV

SEQ ID NO: 403 - protein, 411 aa, Escherichia coli
MKFHSEIKNSIKNAKKFKGILFVNIISYLLLTIAIRKGHSKEILKFKWLILLFGGSVAKYFVARASFLNGDYIFAKKLYQEIIKVNPIHTDSYYGLADVYRLTGNKLEAKDVLIQVFNFSDRLKTWLLLANLVDTKKDYDELLNHWERECSYRNILKYHYDVNDYLIIAALRAKLYEEALNRVKVLLGSINSEAFILPKTSNKNFSVNAAKIALLGLKKILDANKIQFFLVSGTLLGCIRDKKLLKHDKDIDIGVWSETNLSVLSTKIACSGLFDIAPMRSPYTLRIKHVNGVAIDIFFHYRDHDSYWHAGSKLRWNNTPFNLISYGFLGNVFLIPENYDLYLTENYGNWMQEKMKFDSAFDTPNHEIVNMYELKIHAYKKLIINMKIGSVEGVRYYEDKLNELGCIISKP

SEQ ID NO: 404 - protein, 258 aa, Escherichia coli
MARSGFEVQKVTVEALFLREIRTRFGKFRLGYLWAILEPSAHLLILLGIFGYIMHRTMPDISFPVFLLNGLIPFFIFSSISKRSVSAIEANQGLFNYRPVKPIDTIIARALLETLIYVSVYILLMLIVRMAGEYFEITNFLQLVATWSLLIILSCSVGLIFMVVGKTFPEMQKVLPILLKPLYFISCIMFPLHSIPKQYWSYLLWNPLVHVVELSREAVMPGYISEGVSLNYLAMFTLITLFIGLALYRTREEAMLTS

SEQ ID NO: 405 - protein, 576 aa, Escherichia coli
MVYMSNKIFTHSLPMRYADFPTLVDALDYAALSSAGMNFYDRRCQLEDQLEYQTLKARAEAGAKRLLSLNLKKGDRVALIAETSSEFVEAFFACQYAGLVAVPLAIPMGVGQRDSWSAKLQGLLASCQPAAIITGDEWLPLVNAATHDNPELHVLSHAWFKALPEADVALQRPVPNDIAYLQYTSGSTRFPRGVIITHREVMANLRAISHDGIKLRPGDRCVSWLPFYHDMGLVGFLLTPVATQLSVDYLRTQDFAMRPLQWLKLISKNRGTVSVAPPFGYELCQRRVNEKDLAELDLSCWRVAGIGAEPISAEQLHQFAECFRQVNFDNKTFMPCYGLAENALAVSFSDEASGVVVNEVDRDILEYQGKAVAPGAETRAVSTFVNCGKALPEHGIEIRNEAGMPVAERVVGHICISGPSLMSGYFGDQVSQDEIAATGWLDTGDLGYLLDGYLYVTGRIKDLIIIRGRNIWPQDIEYIAEQEPEIHSGDAIAFVTAQEKIILQIQCRISDEERRGQLIHALAARIQSEFGVTAAIDLLPPHSIPRTSSGKPARAEAKKRYQKAYAASLNVQESLA

SEQ ID NO: 406 - protein, 386 aa, Escherichia coli
MVSTRTHANGPADAGRTRLLFAAEIFPMNVFSRYLIRHLFLGFAAAAGLLLPLFTTFNLINELDDVSPGGYRWTQAVLVVLMTLPRTLVELSPFIALLGGIVGLGQLSKNSELTAIRSMGFSIFRIALVALVAGILWTVSLGAIDEWVASPLQQQALQIKSTATALGEDDDITGNMLWARRGNEFVTVKSLNEQGQPVGVEIFHYRDDLSLESYIYARSATIEDDKTWILHGVNHKKWLNGKETLETLDNLAWQSAFTSMDLEELSMPGNTFSVRQLNHYIHYLQETGQPSSEYRLALWEKLGQPILTLAMILLAVPFTFSAPRSPGMGSRLAVGVIVGLLTWISYQIMVNLGLLFALSAPVTALGLPIAFVLVALSLVYWYDRQH

SEQ ID NO: 407 - protein, 356 aa, Escherichia coli
MKLVEHYIMRGTRRLVLIIVGFLIFIFASYSAQRYLTEAANGTLALDVVLDIVFYKVLIALEMLLPVGLYVSVGVTLGQMYTDSEITAISAAGGSPGRLYKAVLYLAIPLSIFVTLLSMYGRPWAYAQIYQLEQQSQSELDVRQLRAKKFNTNDNGRMILSQTVDQDNNRLTDALIYTSTANRTRIFRARSVDVVDPSPEKPTVMLHNGTAYLIDHQGRDDNEQIYRNLQLHLNPLDQSPNVKRKAKSVTELARSVFPADHAELQWRQSRGLTALLMALLAISLSRVKPRQGRFSTLLPLTLLFIAIFYGGDVCRTLVANGAIPLIPGLWLVPGLMLMGLLMLVARDFSLLQKFSR

SEQ ID NO: 408 - protein, 187 aa, Escherichia coli
MMSSRLIIALIIMLLAPGVQAHNFVTGKTVTPVYIQEGGELLLNSDDEIHYQKWNSTQLAGKVRIIQYIAGRKSAKKKNSLLIKAVEAANFPQDRFQPTTIVNTDDAIFGTGYFVVGKIEKNKRRYPWAQFVIDGNGQGRVAWRLPEQSSTILVLNKAGQIQWAKDGSLTPEEVDHVIALAQKLINE

SEQ ID NO: 409 - protein, 502 aa, Escherichia coli
MVYTQATRSKSIMSGNESIDAAHYDQVTTWPRGGLQADIVHIGFGAFHRGHQAVYTDLTNQLSDTRWGIFEINLFGDAQLIENLNAQNGLFSVVETSASQSTSRLVRSVAGGIHTPRDGIAAAIHKLAEPQVKIVSLTITEKGYCLDPQTRSLDLTNGLIQHDLQNPDAPLSAIGVIVCALQQRKATGLAAFSVLSCDNLPDNGHLTRNAVLGFARQLDQPLAQWIEENVSFPGTMVDRIVPAMTESQFALLETKTGYADPCGIVCESFRQWVIEDNFVRGRPEWDKASAMFVSNVQPYEEMKLRMLNGSHSFLAYNGSLAGYEFIWQCMEDANFRSITRQLMINEQARTLNPDLNINIQEYADLLIERFSNRNVAHRTGQIAMDGSQKLPQRALTPWLKLHQQKQNNAVLSLLVAGWLHYVIDAVEKSQSVADPMNDQLQALIKEQQDAWQQALALLHLSAIFGDLSNHQPFINEIKIAFANIKNKGIKATISQLLSDEQK

SEQ ID NO: 410 - protein, 338 aa, Escherichia coli
MKTLICQQPGVMEYVEKDIPTPADNEVLLKIKAVGICGTDIHAFAGRQPFFSYPRVLGHEICAEAVSRGSQCQTAQLGQRYSVIPCIPCGECAACREEKTNCCERVSLYGVHQDGGFSEYLAVREDNLVPLPDEVSDSAGALVECFAIGAHAVRRAEIKAEQNVLVIGAGPIGLATAAIARAKGAHVVVADIDCQRRQHVVDHLAINAFNPTQEDFIAALREAFGGELACVVLDATGNKASMSHDVNLIRHGGKIVFIGLYIGELVIDDPTFHKKETTLLSSRNATREDFALVIKLMRSNKIHENLMKNQAFDFFSVGEDYQRNVVENKNMVKGVITF

SEQ ID NO: 411 - protein, 327 aa, Escherichia coli
MKALRPLTASLMLLTSCLLISNTTLAKTTLKLSHNQDKSHAVHKALSYLADKTKEYSNGELVIRIYPNATLGNERESLELMNSGALQMVKVNAASLESFAPDYSLFSLPFLFRDRDHYYRVLQSDLGKKILNSSESKGFVGITYYDGGARSFYSNKPITKPEDLAGMKIRVQQSPSAIAMMKALGGVATPMAQGELYTALQQGVVDGGENNTVVYADMRHAEVAKVYSRDEHTMVPDVLIISTDVLNKLGDKERTALLKAADESMMQMKDVIWPAAEKEAYDKMKGMNATVVDVDKSAFKERVKPLYDEFKAKDAQSAKNLELVESM

SEQ ID NO: 412 - protein, 160 aa, Escherichia coli
MRTLTHILNKILAGCCCIILAIMVFCVTWQVIARFIFNAPSTVLDEFTQILFMWMILLGGVYTAGLKKHLAIDLLAQKLPAASVLTLDSFIQIIITVFAVIFMIYGGNIVVEKAQHVGQISPVLKWPMDKVYWVMPVSGLILVWYSVMNIIDNYRKRNFH

SEQ ID NO: 413 - protein, 448 aa, Escherichia coli
MTTIVNGIFINEGNMDFEYIYPVLILFGSFAVMLAIGVPITFAIGLSSLLSIITALPPDAAISVISQKMTVGLDGFTLLAIPFFVLAGNIMNTGGIARRLVNLAQALVGRLPGSLAHCNILANTLFGAISGSAVASAAAVGGIMSPLQEKEGYDPAFSAAVNIASAPIGLMIPPSNVLIVYSLASGGTSVAALFLAGYLPGILTAVALMFVAALYARRHHYPVAERINYRQFLQVFRESIPSLMLIFIIIGGIIAGVFTPTEASAIAVIYSLALAMIYREITLKKLNDILLDSVVTSSIVLLLVGCSMGMSWAMTNADVPELINELITRVSDNKWVILFIINIILLIVGTFMDITPAILIFTPIFLPIAQHLGIDPIHFGIIMVFNLTIGLCTPPVGTILFVGCSIGKVSIDRAIKPLLPMFLALFVVMAIICYFPQLSLMLPGLFST

SEQ ID NO: 414 - protein, 295 aa, Escherichia coli
MIQKDKVRVDIFGERFRTRASQLTPGLRVVASYINEHREVVLEQTAMEIAATLNTSDATVIRAIQALGFAGLRDLKRTLEQWLGPALSSSEKMSTTVSNLTSDVNTAIDFVLEGHLYTCNVLSEPENRHALAQAVALLVQARQVAIFGIGASGILADYTARLFNRIGLPATALNRTGIGLAEQLIALQRGDVLIMMAQKSAHREGLTTLREARRLGIPVILLTNALDSRFSKDASIVIHVPRGDEKGKTPLHGTVLLCLEMIVWSVASAVPQRAVKTIKRINDFHRGLKTGRKNG

SEQ ID NO: 415 - protein, 336 aa, Escherichia coli
MVDHFFCYCSGSAGTVFNGSYMRLFFSLLILLSFFSRATEPVQVFTDDLGRKVTVPAHPKRIVSLHDLDITIPLIELGVPPVASHGRTRPDGSHFIRSGALLTGVDFDNSSIAFIGTADIDIEAIVAAKPDLIITEPTRNTPIEQLEKIAPTVSIDHLKGGAPEIYRKLAELTGTQSQLAILERRYQAQINALKATLDSQKITVSVIQANQGKINVMHSYHSLGRVLRDAGFRFPPLIESIPEGGRMDVSAERLPELDADFVFATWRGDTGGKPQDELAAMEKVMPGWCQFLTACRSGRYVLISREEAISNSFASLGLMAAQIQSQIAGRPLPEDK

SEQ ID NO: 416 - protein, 349 aa, Escherichia coli
MSRIMNVGLRPLRVGKFSTLVRPKNLVLLGGLFLFAVGILIFGLMQGSFFVPASEVGRALFAPENVSTDARYIVQDIRLPRVIMALLCGAMLGMAGAAMQSIARNGLADPGLIGVKEGCSVAVLWLIFQFPMLGMFWRPVAGLAGGLLVALIVIFCARDISRPRFVLIGIGVSWFFAAGIGVFMTTADVRDVQTALMWLSGSLHAANWMLVGISACWMLPAALLLLFTARTADIALLGHQVATGLGVNSSRLALLRVAAPIILTAVCVSCVGNIGFVGLIAPHISRFILRGGQTTLLLGSAVSGALLVILADSIGRLAFLPLQLPAGIIISLIGGPFFLLLLWQRRNSF

SEQ ID NO: 417 - protein, 327 aa, Escherichia coli
MMRTGLVTVIFLALLLVGCVVYPGIGARFIAPQTVLQAFLHFDPQNFDHNVIVRLRLPRLAAALLTGASLGVAGALLQAVIRNPLGEPHILGLNAGAALAVVAASALGLAFPVGRPLLASTGGALLFLLILLLSSAGRSGVTPMKVTLCGVALSAFVSSITAAILILDEQTLLAMRTWLAGDLAGQDWATLGTSAWFSLGGFVLALYLAPSLNMLALGDRMAQGLGVSVLRTRTFTLLAIALLCGAAVSIAGPIGFVGLLVPQIVRRLVSADLRVLLPLSACVGALLLLLADIIARTLFTPHELATGVMTALVGAPVFVIMATRMFK

SEQ ID NO: 418 - protein, 598 aa, Escherichia coli
  Xaa 172: Xaa is any amino acid
MFDKYRKTLVAGTVAITLGLSASGVMAAGFKPAPPAGQLGAVIVDPYGNAPLTALVDLDSHVISDVKVTVHGKGEKGVEISYPVGQESLKTYDGVPIFGLYQKFANKVTVEWKENGKVMKDDYVVHTSAIVNNYMDNRSISDLQQTKVIKVAPGFEDRLYLVNTHTFTAQGXDLHWHGEKDKNAGILDAGPATGALPFDIAPFTFIVDTEGEYRWWLDQDTFYDGRDRDINKRGYLMGIRETPRGTFTAVQGQHWYEFDMMGQVLEDHKLPRGFADATHESIETPNGTVLLRVGKSNYRRDDGVHVTTIRDHILEVDKSGRVVDVWDLTKILDPKRDALLGALDAGAVCVNVDLAHAGQQAKLEPDTPFGDALGVGPGRNWAHVNSIAYDAKDDSIILSSRHQGVVKIGRDKQVKWILAPSKGWEKPLASKLLKPVDANGKPITCNENGLCENSDFDFTYTQHTAWISSKGTLTIFDNGDGRHLEQPALPTMKYSRFVEYKIDEKKGTVQQVWEYGKERGYDFYSPITSIIEYQADRNTMFGFGGSIHLFDVGQPTVGKLNEIDYKTKEVKVEIDVLSDKPNQTHYRALLVRPQQMFK

SEQ ID NO: 419 - protein, 222 aa, Escherichia coli
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYDVAKIQGVPAYVVNGKYLIYTKSIKSIDAMADLIRELASK

SEQ ID NO: 420 - protein, 223 aa, Escherichia coli
MGIKGMWKDLRTSPVDTLVRWQEQRLLWLLMAVAMGALIILAHSFFQIYLYMAPCEQCVYIRYAMFVMVIGGLVAAINPKNIILKLIGCVMAFYGSILGLKFSLKLNDIHHAVHNPDPDSLFGVQGCSTDPTFPFNLPLAQWAPNWFKPTGDCGYDAPIVPDGVTLSSTQQWFVEMYQQSEGWYLLPPWHFMNMAQACMLAFGMCLVLLVIMSGAWALKIIRG

SEQ ID NO: 421 - protein, 61 aa, Escherichia coli
MKVKRMFIAWYWIVLIVLLAGGYFLHLKRYCKAFRHDRDALLAARSKLDKRSDKEVFEKHQ

SEQ ID NO: 422 - protein, 187 aa, Escherichia coli
MLKKTLLSMFATALLSGVAFNALADDANQGSGKITFKGEVIDAPCSIAPGDEDQTINLGEVADTVLKSGQKSLPVDVTIHLQDCILSDGTNTVDKVKITFSSASVDATDSNLLKNTLEGNIGGATDVGVRLVKSDNTNVTLGTPITINFPTTNSYQELNFKARMESLGRTATPGNVQAQANYVLDYK

SEQ ID NO: 423 - protein, 840 aa, Escherichia coli
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGITGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 424 - protein, 249 aa, Escherichia coli
MNIMKLPLITTGMICFLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMVPLQKVTITRTAAGLTLNNPTPYHITVGYIGTNGKTLMPGADSIMVAPFASATQHLNNLPSTFQLGFVADYGGLEMFKVVCNSVQSLCQSTPAKKGKI

SEQ ID NO: 425 - protein, 349 aa, Escherichia coli
MITLFRLLAILCLFFNVSAFAVDCYQDGYRGTTLINGDLPTFKIPENAQPGQKIWESGDINITVYCDNAPGWSSNNPSENVYAWIKLPQINSADMLNNPYLTFGVTYNGVDYEGTNEKIDTHACLDKYEQYYNGYYHDPVCNGSTLQKNVTFNAHFRVYVKFKSRPAGDQTVNFGTVNVLQFDGEGGANMAPNAKNLRYAITGLDNISFLDCSVDVRISPESQIVNFGQIAANSIATFPPKAAFSVSTIKDIASDCTEQFDVATSFFTSDTLYDNTHLEIGNGLLMRITDQKTQEDIKFNQFKLFSTYIPGQSAAMATRDYQAELTQKPGEPLVYGPFQKDLIVKINYH

SEQ ID NO: 426 - protein, 294 aa, Escherichia coli
MKMASNQTTLPNVSENEETLLTGVNENVYEDQSIGAELTKKDINRVAWRSMLLQASFNYERMQASGWLYGLLPALKKIHTNKRDLARAMKGHMGFFNTHPFLVTFVIGIILAMERSKQDVNSIQSTKIAVGAPLGGIGDAMFWLTLLPICGGIGASLALQGSILGAVVFIVLFNVVHLGLRFGLAHYAYRMGVAAIPLIKANTKKVGHAASIVGMTVIGALVATYVRLSTTLEITAGDAVVKLQADVIDKLMPAFLPLVYTLTMFWLVRRGWSPLRLIAITVVLGIVGKFCHFL

SEQ ID NO: 427 - protein, 181 aa, Escherichia coli
MPFEISPQVLGADASNFHISEPLTMALLLTIVFTTTKLNDFNFLATTVSNNFSFDYAAINERNADFDFFTVCDHQHFSELNSFASCDVQLFQANGLTFAYSVLFTTTLENRVHIKLRFRAHLFNDSECAINIHNRARILRKTHAFDKCYSQYTKKKNTTCTVTFICAIFSVQSPYIPNHKP

SEQ ID NO: 428 - protein, 329 aa, Escherichia coli
MTEKTLASPKPSEIPIANNFKKVFRQYGGILSGMVVLIILFSFINDSFFTANNITNIILQVSIIAITAYGMTYVLLLGDIDLSVGSTIALIGTFAALGASWGIPFVLLVPLSIIAALALGMINGGLTAIAGIPSFIVTVATMGIFRGIAYIVTDGMPIMIKDDAFLALGNGEFLYIPIPIWILIILLLINHFILTKTTFGRKIYITGGNKEAAIYSGINVTRLKIKVFMITAVLAGISGMILASRLYSGQPNSALSYELDAIAAAVLGGTSLNGGYGTVVGTVIGALTIGVINNGMNLMNVPYFYQMVVKGLVILVAVYFDVRNKRKRS

SEQ ID NO: 429 - protein, 298 aa, Escherichia coli
MFMKNIKLLGSAMLVSLALFSQSSLAKEYKIGASLLTQQHPFYIDLANAMKEEAKKDNVNLSVSIANQDLNKQLSDVEDFITKKVDAIIISPVDSKGVQAAIIKADKAGIPVITVDVAAEGVPVVSHVATDNYAGGVEAGKLMGKLLHGKGTVAIISYPALQSVVARVDGFKKGLSDTPDIKIVAEQPGITRAEALTTAQNIMQANANLNGLFGFGDDAALAAVIAAKSAHNDNIKIIGFDGMKEARDAVDSEKTFAAVIRQYPDQMGAKAIDAAVDHLNGKPVEKMIPVQPGVYTGK

SEQ ID NO: 430 - protein, 42 aa, Escherichia coli
MFLLEIIYIAAPVIGRSPYKMKKENLYFHFESKLAQQKQQKA

SEQ ID NO: 431 - protein, 201 aa, Escherichia coli
MIKFRLYIPPVILGFVIVPLLVWPTVIALAVLIFTLTFLAEIIFSFPLLVVRISLQELQLELLVVYALFFSVMGGIGWQFSRRTPPELKNRLHCWLVFSPVYFWLILSNFILYISPEKSALLENIRNFFLTFVWLPLNFSPFWPQPWTDFVGPISAQLGFALGYYCQWRSKNRSHRKKWGDWVTCLSLAILALGPLFNYLQ

SEQ ID NO: 432 - protein, 255 aa, Escherichia coli
MHPTPAMQALIEQIYHIFRRYPAPKQFVVCCEYCLSQQEQKALRNTSLRAIPYSLINAWNSSPGPDPQNSDEVRYFLPRLLEFVAQGQFDNIHEVFSLRRINLASKENWREDEREILQQFACQYMTDWVSGDEAVELQYKLEMFFRADIALSPLLDAIISVPGFWSAASLACLLNTYRDGYIRDNQDDIDKAITAQINAWAFNNQSILKERARQAIENPLKQPEQGTQYQIWEDDWMIDECLCAMYDASSESPGK

SEQ ID NO: 433 - protein, 336 aa, Escherichia coli
MRIHTYWYRRYFILLIIIFSNVLSSIANAEDMGRERAYCYPGSPSNNTTPASFSYNFGTIVVSDVNKNAPGTVLPSQIWKVGTYKAYCNSLDDYEIYFSAVSGIDPSGASGDHQGSDVFIPLTHEISVSTHIKLYNQNGTMTDKIVPFENYNTNYPGDRSKPSNWASGTEGYIKIRIDKKIISDVSLSNVLLVSLYVSQIPTEHGPIPVFNAYIGNLNIQVPQGCTINEGTSFTVNMPDVWASELSRAGAGAKPAGVTPVATTIPINCTNKDTDAVMTLVFDGNISATRDTNGKQSIIQAQDNPDVGIMIMDSQQNSVDLNALATSVGVPFRLVEN

SEQ ID NO: 434 - protein, 265 aa, Escherichia coli
MSNQGMQMRQYRLLSPMIKVVIVLFSLLFSTAQAGLVIGGTRFAYPENQSSISVELKNTSDRDMLVKVAVSPDDARQLTGTVESLPSYSETVFIATPPLFILKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 435 - protein, 185 aa, Escherichia coli
MLCCILISIISEGDMKIFISLFLFIISTNSFADDITHAGVVRIEGLITEKTCIISDESKNFTVNMPDVPSSSVRSAGDVTEKVYFSITLTRCGSDVGNAYIKFTGNTVSEDASLYKLEDGSVEGLALTIFDKNKGSISNDVKSMVFSLTSSVDNILHFFAAYKALKNNVQPGDANASVSFIVTYD

SEQ ID NO: 436 - protein, 864 aa, Escherichia coli
MNLKLKRCEYWMAAQKQMKRVVPLLLVIMPACSIAGMRFNPAFLSGDTEAVADLSRFEKGMTYLPGSYEVEVWVNDSPLLSRTVTFKADDENQLIPCLSLADLLSLGINKNALPEQALASSENSCLDLRIWFPDVHYMPELDAQRLKLTFPQAIIKRDARGYIPPEQWDNGITAFLLNYDFSGNNDRGDYSSNNYYLNLRAGINIGAWRFRDYSTWSRGSNSAGKLEHISSTLQRVIIPFRSELTLGDTWSSSDVFDSVSIRGIKLESDENMLPDSQSGFAPTVRGIAKSRAQVTIKQNGYVIYQTYMPPGPFEISDLNPTSSAGDLEVTIKESDNSETVYTVPYAAVPILQREGHLKYSTTVGQYRSNSYNQKSPYVFQGELIWGLPWDITAYGGAQFSEDYRALALGLGLNLGVFGATSFDVTQANSSLVDGSKHQGQSYRFLYSKSLVQTGTAFHIIGYRYSTQGFYTLSDTTYQQMSGTVVDPKTLDDKDYVYNWNDFYNLRYSKRGKFQASVSQPFGNYGSMYLSASQQTYWNTDKKDSLYQVGYNTSIKGIYLNVAWNYSKSPGTNADKIVSLNVSLPISNWLSSTNDGRSSSNAMTATYGYSQDNHGQVNQYTGVSGSLLEQHNLSYNIQHGFANQDNSSSGSVGVNYRGAYGSLNSAYSYDNEGNQQINYGISGALVVHENGLTLSQPLGETNVLIKAPGANNVDVQRGTGISTDWRGYAVVPYATEYRRNNISLDPMSMNMHTELDITSTEVIPGKGALVRAEFAAHIGIRGLFTVRYRNKSVPFGATASAQIKNSSQITGIVGDNGQLYLSGLPLEGVINIQWGDGVQQKCQANYKLPETELDNPVSYATLECR

SEQ ID NO: 437 - protein, 259 aa, Escherichia coli
MLFHQQGCCMKCIIGNKKWVCGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 438 - protein, 234 aa, Escherichia coli
MKFNLSNLSAVLLASGMLMSTAVTAAPGDATQFGGADTDWSTVDYPRLTDMDDNVDSMGGKIRFTGRVVKATCKVATDSKQIEVVLPVVPSNLFTGIDVEAQGASNQTDFNINLTECSNTDDQKIEFRFTGTADSANKTLANEVEGSTDADNSGNAGATGVGIRIYSKGTTNNGLINLNTTAAEGSASTAAYTIPGNATTHDFSAAFTAGYAQNGSTVAPGVVKSTASFVVLYE

SEQ ID NO: 439 - protein, 93 aa, Escherichia coli
MSQTILFVCATGIDTSTAVTEKVMEYCKEHGLNVNYSQTNVASLPGNTDGVALVVSTTKVPYELDVPVVNGLPIITGIGEEKVLAQIVSILKK

SEQ ID NO: 440 - protein, 462 aa, Escherichia coli
MRSRLKKRFIMNDIAHTLYNIVQYILGFGPTVMLPLVLFILALFFKVKPAKALRSSLTVGIGFVGIYAIFDILTSNVGPAAQAMVERTGINLPVVDLGWPPLSAITWGSPIAPFVIPLTILINVAMLALNKTRTVDVDMWNYWHFALAGTLVYYSTGSLFFGLLAAAIAAVVVLKLADWSAPLVQKYFGLEGISLPTLSSVVFFPVGLLVDKIIDHIPGLNRIHIDPETVQKKFGIFGEPMMVGTILGILLGVIAGYDFKKVLLLGISIGGVMFILPRMVRILMEGLLPLSEAIKKYLNAKYPDRDDLYIGLDIAVAVGNPAIISTALLLTPISVFIAFVLPGNEVLPLGDLANLAVMASMIALASRGNIFRTVLAAIPVIIADLWIATKIAPFITGMAKDVNFKFAEGSSGQVSSFLDGGNPFRFWLLEIFNGNIIAIGLVPVIALVLYGIFRMTRSTVYA

SEQ ID NO: 441 - protein, 131 aa, Escherichia coli
  Xaa 76: Xaa is any amino acid
MYCLVFIITFAAYFHRFSAFYSGAHNIHHAGGINIITFIVQRHFTAIFFGGFRQTGRRTCMQASTVSDFHGFTQHXAPPDDVMASRLLAVISTDTSFSICADNAVIDGISPDSVTNVGYGDLRRWNIRCGG

SEQ ID NO: 442 - protein, 648 aa, Escherichia coli
MLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 443 - protein, 330 aa, Escherichia coli
MNRRLYFIYNSNDNHDHSQFDKSSHIMPRIITRPFLFSPLTLCISAVVSAAKTMVKRKKLFTALLALSWTFSVTAAERIVVAGGSLTELIYAMGAGKRVVGVDETTSYPPETAKLPHIGYWKQLSSEGILSLRPDSVITWQDAGPQIVLDQLRAQKVNVVTLPRVPATLEQMYANIRQLAKTLQVPEQGEALVTQINQRLERVQQNVAAKKAPVKAMFILSAGGSAPQVAGKGSVADAILSLAGAENVATHQQYKSYSAESLIAANPEVIVVTSQMVDGDINRLRSIAGITHTAAWKNQRIITVDQNLILGMGPRIADVVESLHQQLWPQ

SEQ ID NO: 444 - protein, 330 aa, Escherichia coli
MLKDSLSSARVFMGLSLLLLALVLFGASQGALKISFDALFDEEYRDIWLNIRLPRVLLAVLVGAALATAGVIMQGLFRNPMADPGLLGVSSGSALMVGVAIVLPFSFPVVLVLYEQMVFAIAGSLVVCTIIFLITQRHRDGSMMQLLLAGIAINALCGAAIGILSYIGDEQQLRQLTLWMMGNLGQAQWPTLLVASSFILPAIIATTCLAGTLNLLQLGDEEAHYLGVNVKRKRQQLLLVSSLLVGAAVSVSGIIGFIGLVIPHLIRMTTGANHRWLIPCSALAGACLLLMADTLARTLVQPAEMPVGLLTSLLGGPYFMWLILRNRRIT

SEQ ID NO: 445 - protein, 169 aa, Escherichia coli
MTRAYLRSKMRPAFGDWRSLVAHFVRDEGVGGSNPLSPTKFEKPAQRAGFFASVAHEEENPRGRGGSTRRRPDKTRQRRIRQMYRPIVGCGATALFDLHTTHFLSKFAPHISLSINGFVTETIVFFYICLNLFVRYLWLALAFSAVRFSVHGINRSDIHLFLRFFSQNA

SEQ ID NO: 446 - protein, 155 aa, Escherichia coli
MKRILEGILAIIIAILSCIIFINIILRYGFHTSILSIDELSRLLFVWLTFIGAIVAYMDNSHVQVTFLVEKLSPANQQRVSLLTHTLILLLCLGLAWGAIEKTAQDWSNLSPILGVPIGLMYAAAIPTSLIIALLELRHLYRQFTNTPSRNQQGA

SEQ ID NO: 447 - protein, 425 aa, Escherichia coli
MTILIFIVSLLGAIAIGVPIAWALLLCGISLMFWMDIFDVQILAQTLVNGADSFSLLAIPFFVLAGEIMNAGGLSQRIVDLPMKLVGHRPGGLGYVGVLAAMIMASLSGSAVADTAAVAALLVPMMRQANYPVNRAAGLIGSGGIIAAIIPPSIPLIIFGVSSGLSISKLFMAGIAPGIMMGVTLMVTWWWQAKRLNLPCQPKASLREVWQSLVSGIWALFLPIIIIGGFRSGLFTPTEAGAVAAFYALFVSVVVYREMTFSTLYHVLINAAKTTSVVMFLVASAAVSAWLITIAELPMMVSELLQPLVDSPRLLFIVIMLAIMVISTVMDLTPTVLILTPVLMPLVKEAGIDPVYFGIMFIINCSISLITPPVGNVLNVVCGVAKLKFDDAVKGVAPYVMVLFMLLALFIFIPELITAPLKWMS

SEQ ID NO: 448 - protein, 245 aa, Escherichia coli
MKGCPACIAGHYQVWLLPVIGIGPMLTQVVLIQQFVLHRRELWRKLAREQTHIGALFQYHGVMHRIGGIFSPGERAVRMHQYRRDLCRVQPTLFEGFNDHFAGLVFILAVDLFCGHQARAGDGSVKIIGVSSAPGGEIKSGLRPDGGVARVGMHYAANLRKATVKRQMRWRVGRGLFAAFHHLAAGYLNHHHIVGGHYLILNAGRLNHHPLPRFVYRADIAPGERHQMMNGKRQVCRQHVSFQLL

SEQ ID NO: 449 - protein, 136 aa, Escherichia coli
MQAHFAAQRGHWVHNHQSANTFFQLAHISLLFFGDCTLERHLHQFLRFFAEFLAVNFAQASNFCFQSGFLFFQFGIFVCGFNQRQIGLLVTDGVQTIAETFDFVFFDFFHVMTSDRDKFIASSMRDQVLCSQLMAL

SEQ ID NO: 450 - protein, 227 aa, Escherichia coli
MNLKKTLLSVLMILQLCLLVGCDYIEKASKVDDLVTQQELQKSKIEALEKQQELDKRKIEHFEKQQTTIINSTKTLAGVVKAVKNKQDEFVFTEFNPAQTQYFILNNGSVGLAGKILSIDAVENGSVIRISLVNLLSVPVSNMGFYATWGGEKPTDINALAKWQQLLFSTAMNSSLKLLPGQWQDINLTLKGVSPNNLKYLKLAINMANIQFDRLQPAESPQRKNKK

SEQ ID NO: 451 - protein, 1778 aa, Escherichia coli
MNKIFKVIWNPATGSYTVASETAKSRGKKSGRSKLLISALVAGGLLSSFGASADNYTGQPTDYGDGSAGDGWVAIGKGAKANTFMNTSGASTALGYDAIAEGEYSSAIGSKTLATGGASMAFGVSAKAMGDRSVALGASSVANGDRSMAFGRYAKTNGFTSLAIGDSSLADGEKTIALGNTAKAYEIMSIALGDNANASKEYAMALGASSKAGGADSLAFGRKSTANSTGSLAIGADSSSSNDNAIAIGNKTQALGVNSMALGNASQASGESSIALGNTSEASEQNAIALGQGSIASKVNSIALGSNSLSSGENAIALGEGSAAGGSNSLAFGSQSRANGNDSVAIGVGAAAATDNSVAIGAGSTTDASNTVSVGNSATKRKIVNMAAGAISNTSTDAINGSQLYTISDSVAKRLGGGATVGSDGTVTAVSYALRSGTYNNVGDALSGIDNNTLQWNKTAGAFSANHGANATNKITNVAKGTVSATSTDVVNGSQLYDLQQDALLWNGTAFSAAHGTEATSKITNVTAGNLTAGSTDAVNGSQLKTTNDNVTTNTTNIATNTTNITNLTDAVNGLGDDSLLWNKAAGAFSAAHGTEATSKITNVTAGNLTAGSTDAVNGSQLKTTNDNVTTNTTNIATNTTNITNLTDAVNGLGDDSLLWNKTAGAFSAAHGTDATSKITNVTAGNLTAGSTDAVNGSQLKTTNDNVTTNTTNIATNTTNITNLTDAVNGLGDDSLLWNKTAGAFSAAHGTDATSKITNVKAGDLTAGSTDAVNGSQLKTTNDNVSTNTTNITNLTDAVNGLGDDSLLWNKTAGAFSAAHGTDATSKITNVKAGDLTAGSTDAVNGSQLKTTNDNVSTNTTNITNLTDSVGDLKDDSLLWNKAAGAFSAAHGTEATSKITNLLAGKISSNSTDAINGSQLYGVADSFTSYLGGGADISDTGVLSGPTYTIGGTDYTNVGDALAAINTSFSTSLGDALLWDATAGKFSAKHGINNAPSVITDVANGAVSSTSSDAINGSQLYGVSDYIADALGGNAVVNTDGSITTPTYAIAGGSYNNVGDALEAIDTTLDDALLWDTTANGGNGAFSAAHGKDKTASVITNVANGAVSATSNDAINGSQLYSTNKYIADALGGDAEVNADGTITAPTYTIANTDYNNVGEALDALDNNALLWDEDAGAYNASHDGNASKITNVAAGDLSTTSTDAVNGSQLNATNILVTQNSQMINQLAGNTSETYIEENGAGINYVRTNDSGLAFNDASASGIGATAVGYNAVASHASSVAIGQDSISEVDTGIALGSSSVSSRVIVKGTRNTSVSEEGVVIGYDTTDGELLGALSIGDDGKYRQIINVADGSEAHDAVTVRQLQNAIGAVATTPTKYYHANSTAEDSLAVGEDSLAMGAKTIVNGNAGIGIGLNTLVLADAINGIAIGSNARANHADSIAMGNGSQTTRGAQTNYTAYNMDAPQNSVGEFSVGSEDGQRQITNVAAGSADTDAVNVGQLKVTDAQVSQNTQSITNLNTQVTNLDTRVTNIENGIGDIVTTGSTKYFKTNTDGADANAQGKDSVAIGSGSIAAADNSVALGTGSVADEENTISVGSSTNQRRITNVAAGVNATDAVNVSQLKSSEAGGVRYDTKADGSIDYSNITLGGGNSGTTRISNVSAGVNNNDAVNYAQLKQSVQETKQYTDQRMVEMDNKLSKTESKLSGGIASAMAMTGLPQAYTPGASMASIGGGTYNGESAVALGVSMVSANGRWVYKLQGSTNSQGEYSAALGAGIQW

SEQ ID NO: 452 - protein, 87 aa, Escherichia coli
MLCVNKNLWNRGATAAFDHLFTLSGIAIDRQLLKTHALAAQQCFCTMAIRAGFFGIDFNIGHKLAPVFYPEISCCRAAAKWSVPRSL

SEQ ID NO: 453 - protein, 417 aa, Escherichia coli
MSFCWNEINSGVKSLILILCMLSLMTLSLWDDVATKFLHAAGIISALYFLATPKNTITNNPTLLIFISLCLLGIVNIIWYSHYKVSGSVYTNAYRGPMETGKIALCSAFIFLVLFAKDEMRTKIKFGKLILFASLATQLLFFAHAMWQHFYLNVDRVALSASHATTAGYIILFPSLLASILILKSDFRHKTTLYTINFMLSLCAVIVTETRAAILVFPFFALLLIVMDSYINKRINYKLYCFIAIALLAGVFSFKDTLLTRMNDLNRDLVNYSHDNTRTSVGARLAMYEVGLKTYSPIGQSLEKRAEKIHELEEKEPRLSGALPFVDSHLHNDLIDTLSTRGIPGVALTILAFSAIFIYALRTAKEPYILILLFSLLVVGLSDVILFSKPVPTAVFVTIILLCAYFKVQSDQCLLDK

SEQ ID NO: 454 - protein, 327 aa, Escherichia coli
MSNDYPLVSIIIPTYNSSDYITETLTKLEKQTYPNFEIVIVNDGSKDNTSSVLREYGLTHSRLIIINKENGGVSSARNTGIRKAQGQFICFMDDDDEIDPNYLLKMYSRQHETGGDAIYCGLYGHHIKNGVTYSPINTDFNEGSLLFDFFYKKVRFHIGCLFIRKQLLEDNNLFFDEDLRLGEDLDFIYRLLITCDMYAVPYYMYKHNYRENSLMNSCRTITHYRHESFAHERIYSSVMQLYKGNRKEEIHTLLSKNRTYHKTRYLWNVLLNGDFELLNQLVESNEKELKDCNLLGKRDKRRAKILASKNYILWRMVRLVNRKKNKR

SEQ ID NO: 455 - protein, 352 aa, Escherichia coli
MDKPFRRILLIKMRFHGDMLLTTPVISSLKKNYPDAKIDVLLYQDTIPILSENPEINALYGIKNKKAKASEKIANFFYLIKVLRANKYDLIVNLTDQWMVAILVRLLNARVKISQDYHHRQSAFWRNSFTHLVPLQGGNVVESNLSVLTPLGLESLVKQTTMSYPPASWKRMRRELDHAGVGQNYVVIQPTARQIFKCWDNAKFSAVIDALHARGYEVVLTSGPDKDDLACVNEIAQGCQTPPVTALAGKVTFPELGALIDHAQLFIGVDSAPAHIAAAVNTPLISLFGATDHIFWRPWSNNMIQFWAGDYREMPTRDQRDRNEMYLSVIPAADVIAAVDKLLPSSTTGTSL

SEQ ID NO: 456 - protein, 321 aa, Escherichia coli
MTRLLRNKERDMHYLGLDIGGTKIAAVVMDAHGWEIRRYRCPTQKSTYQQFVSCVVALIEQIRRDVQRPMLTGIALPGSISPLTGLIKNANIQVINGHALQADLQQLLGQPVVIANDGNCFALSEACDGAGQDYDVVFGITLGTGCGGGIAIKQRPFIGAWGNAAECGHITLPGYTEQEDGPSVSCYCGKHNCVESFVSGSGFSERYQQMTGNLLTSAAIVTLAQRGDACAMQQVARFRQQLARTLATIVNVVDPGVIVIGGGLSNVELLITDLNAEVAPLVFTDQFTTPIVKAQHGDSSGMRGAAWLAMRNGEANETFTN

SEQ ID NO: 457 - protein, 283 aa, Escherichia coli
MFADMKSMVMKAWHEHYALLAINCMNLESAHAAIRVAEKNRAPIILNLYQGHLAHFPAPVAAAVVKTLAESASVPVALALDHGKNPDCIRQAFRAGFSGLMIDASAFPLEENVRQTRAVVELAASAQLCVEGELGHLADAPRYDQAANADMMTQPTDVEPFIVQTGIDLLAVSVGTAHGMYAPGVVPAIDFQRLAEIFHCSSVPLALHGGSGTPFDQLQLCTTLGVAKINVGAAIFERGKSALLHTLCHDISIELVDALKAMELAFEEAITPYLQASGSIGKA

SEQ ID NO: 458 - protein, 363 aa, Escherichia coli
MKENKIPVSQEIKKHLLTGISWMIPLIVAAGICIALGQVLGGTDVGEKTGTIPWMLNQIGGWGMGLIVPLISAAIAYSIADRPGFVPGLIVGFLCGQIHTGFIGGMLGGFLVGYTILLLKRYIRLPQSMQGLMPIMVLPVLSTIIGGLLMMTLIGKPIAWLQEALIHLLESMQGGSRFLMGAILGAMATFDFGGPVNKTMSLFSDGLLVSGVYGPEAVKFVGSIIPPFGITLSFLLTRHKYTRAEREALKAAFPMGICMITEGVIPIAARDLLRVVGSCVVASAVAGGLIMVWGVESPVPHGGMFVVPLFTHPLLFCLALGIGTVICGVMLSLWKKPVTERDEEFDELSDQKLKDEEITFTLE

SEQ ID NO: 459 - protein, 104 aa, Escherichia coli
MNIVCVAACTAGIAHTYIAREKLIKGAKALGHTIKVETQGTIGTENELQAADISAADVVILAVDVKIKGEERFTNKRIVRVKTEIVIKSPVQFLEKVEKSLGNK

SEQ ID NO: 460 - protein, 76 aa, Escherichia coli
MNYPMDSLTPFHNALLSNTLWLTSKKTGFPLPAGNHLPGVFGWSGYSCLVISKIIAINSGKLIVHNLVMNITLIFP

SEQ ID NO: 461 - protein, 364 aa, Escherichia coli
MKLEIDHNMEKKLKIADIAMRTGLSSSTVSRVLAGKANTSYRAREKVLACARELGVMDGMASGRMLLNNLVIFAPQRAFDERTDIFYFRVIQSISKALSHYEVRLRYCALDEFDSTPSKFLARMNEAETQAAILLGIDDPHIHDLAADFSKPCVMINCHDRRMRLPTVAPDHKNIGAFASHFLFEMGHRRVMNIMCLRRYTMELRLAGIKEAWERQNQNFKDDRDLLTINSFSAKEAEEKVGAWLDMTEKSMLPTAFLASGDFIAAGIINALKKRNIRVPQDVSVMSIDGFNLAAIEDVPLTAVHVPRDELGTEAVHMLQQRLVRPDATVGALLLYGKLVIRESVRRIRPGKEPTPIKGDRLYD

SEQ ID NO: 462 - protein, 452 aa, Escherichia coli
MATPSCVVARSFITSGGVIMSQDINNNIAVSKHRRIIRQLRWWMLILFLMGVTVNYITRNSLGILAPELKDSLGITTEQYSWIVGGFQLAYTLFQPLCGWLIDVIGLKIGFMICASLWGIACLLHAGAGSWIQLALLRFFMGGAEASATPANAKIIGEWFPKSERPVAAGWAGVGFSIGAMLAPPIIYFAHASFGWQGAFMFTGALAILWVFLWWACYNTPEEHPNLSKNELNFIRQDNEAPPVKMPFLTALKTVSKNKRFYGIAIPAFMAEPAWAVMSFWVPLYLAKAYGMDLKQIALFAWLPFLCADLGSIASGYLTKLYTRLFGLSRVNSVIASSVSGAFLMVSLAVIAFIDNPYIAIVLISIGGFGHQIISCMLSALVVESFDKGQMATVNGMRGSAAWIASFLFSLIIGVTADKIGFNPLFIAMGFFDLIGAFFLVTFIAERRKKRT

SEQ ID NO: 463 - protein, 594 aa, Escherichia coli
MDYFMITSAIVGLDLGNEIDNYHTTYRRWQAEAGDIDYYLFTGRCVLDITKAFVRLTGKTLFGPKWSLGYSGSTMHYTDAPDAQNQLMQFIRLCKEHAIPCDSFQLSSGYTSINGKRYVFNWNYDKVPHPKMMSQEFHNAGIHLAANIKPCLLQDHPRYNEVAEQELFIRDSEYNVPERSSFWDDEGSHLDFTNPQTVAWWQEGVTTQLLEMGIDSTWNDNNEFEVWDGEARCHGFGKEIAIKHIRPVMPLLMCRASMEAQQKFAPNKRPYLISRSGCAGLQRYVQTWSGDNRTNWDTLRYNTRMGLGMSLSGLYNIGHDVGGFSGDKPDPELFVRWVQNGVMHPRFTIHSWNDDHTVNEPWMYPEVTPAIRSAIELRYRLMPYLYTLLWQAHADDEPILRPTFLDHEHDVQTFEECDDFMLGRDILVASVVEAGQRQRRVWLPDNKTGWYDFYNGEWFCGGQWITIDAPLEKLPLLVRAGAGIPLSERITYVSEAEDNHRKLKLFPIKGTGKSTGLLFEDDGETWGYTEGNALWLEWELDCTATTIELRINTHGDYRPAWETLKVIIPQGESRQLLINGIEAYEWNMNLSCND

SEQ ID NO: 464 - protein, 499 aa, Escherichia coli
MAEQSSDVKNSDNSAGGHKLGLISLIAIVVSSMLGGGVFSLPQNTAASSALGPVIIAWIIAGIGIYFIANSFRVLSDLRPDLQAGVYMYAQEGFGSFIGFNVAWGYWLMTAFGNVAFAVILMDAFNQFMPGVFTDGNNLNSIICGSVLIWGYNFLVLSGTKVAGFVNTLGTIAKLVPLILFVLLLGVLIDYSDLFKNFWGESPAILSGNGNDAAPVSLLSQILAPMTVTLWAFIGVEGAVVLSGRAKNKQDVGKATLIGFLLALIIYMLMSILPFGVMPQAELAQVSNPSTAGVLAHVVGQWGDWLMSAGLIISVLAGWLAWTMLCAEIPMVAGQKGAFPRAFARTNSKQAANVSLWVSSFVMQAAMLLVYFSNNAWTTMYNISALMVVPAYITTTLYLTSICRNGKYDQYAKKGRRLALSSGVLGSLFCLFILYASQIEYVALIPILLTCGLPVFIWSRKEKNDGQPIFTKKELIYLIMLLLCDIIVVALFIGGYLKV

SEQ ID NO: 465 - protein, 489 aa, Escherichia coli
MHIDSTEKNNKQKLGLLALTSIVVSSMIGSGVDGLPQNMAENSAVGPVAIAWIVCGIGMFFISRTFIVLSNIRPDLQSGVYMYAREGFGRFTAFNVAWGYWLMTIFSNVAFAIMVMDTLNYFLPGDFKGGNNIPSVIGASLLIWGFNFLVLSGTRIAGSINIVGTLAKLIPLVAFIIILMLFMKYTTFADNVWGHSASKASQDLGSIFSQVTSPLSVALWSFIGVEGAVALSGRAKNKRDVGKATFIGFVVSLIICLLVSILPFGVLTQHELSAIPTPSTAGILKIVVGEWGKIMIILGVLISVLTSWLAWTIICAELPMVAAQNGTFPKPFSKKNVKGSASVSLYISSAFMQIVVLLVYFSNDAWLAMLAISTLTVLPAYLMTTAYLFKLCISGEYASYTTNHSRSAALVSSIIGFVFCLFMFYASEIKYLAMVPVLLTLGVPLFIWARKKDDRADKIFTLRELAFFILLLVLDIIVFILLHYKTIHF

SEQ ID NO: 466 - protein, 191 aa, Escherichia coli
MTQSEMLKLIARHGYNVGFGAKKNFATYDLICKASGWISFISLAVGVFALFIPELATNVISAILIIFGVATMYIQFYDSEKQSYESAGIEQTKIFNELEVIYRNVKSDANFDYQRTQQSIDAIMSRFYSTVISKQIFGSNWYAHYKFYCEFEKAWVEEELNLTLKDKIPLSLCFLASLAIIFTIAVIWKTP

SEQ ID NO: 467 - protein, 439 aa, Escherichia coli
MGGIPVTQLVFHHKHHHLPPASEKVLPVQLYGLSGQRRGDISVIGNPAIDRIRRLGVQLPAKVMDFLSVALAVTAADTFVQRESSEDGWTRQLSLRLPLHEPSRWISLKKELESALHFLSGDIWDFEFCDDGYAPPEPYSQHSRHRLIKLKGLDCVSLFSGGLDSAIGAIDLLAAGRAPLLVSHAYKGDKSRQDQIAEKLSGQFSRFEINADPHIYQGVTDITMRTRSLNFLAFAAVGACAVQEISQQEKIDLFVPENGFISLNAPLTPRRIGSLSTRTTHPHFITSIQKIFDALGISCQIINPYQFKTKGKMISECSNKQLLSKIVESTVSCSHWKRMGQQCGVCIPCIIRRASLHAGGISRDVEYIFQSLAKVMNEIDRRDDLIALRIAITQKSTLKIGTWIAKSGPLPTAEFDNYKQVFKDGLDEVESYLLSENIV

SEQ ID NO: 468 - protein, 594 aa, Escherichia coli
MWSDKESSEDYLNFGEVSQLAVDVLTTKDMLPVSIGIFGNWGAGKSSLLKLIEQKLEQDDKDWIVINFDSWLYQGYDDTRAALLEVIATELTKAAEGNSTLISKTKRLLSRVDGFRAMGLLAEGTALMAGLPAGGLLSRGIGALRNITDGIQSQEEYEALGNIAKEGKETACGLIKPQTKKSPPQQIDAFRKEYGEILEELGKPLIVVIDNLDRCLPANAIHTLEAIRLFLFLTNTAFIIAADEDMIRSSVADYFKGASQRHQIDYLDKLIQVPIRVPKAGVREIRSYLFMLYAIEHGLEGEKITMLREGLEKALQQSWKDEPISRQEALKMTGEADDSNLALAFARADRIAPILANSPIIHGNPRIVKRLLNVVKMRSQIAKRRAMPLDEAIITKLVIFERCVGVDGTADLYHLVDIEQGVPQILKQLDDNGGQIPTDAPKTWTDSPTTKSFISQWAQLEPRLGGIDLRAAIYLSRETMPIGAYVVGLSPSGREVLNALIELKNTSSPTAENLLKALPREEQIPVMEGLINQLRQVSDWDRKPRGFSGACLLARYSTDAASILIRYLQELQLGMKRPAWMTAALKDEQWNKDA

SEQ ID NO: 469 - protein, 145 aa, Escherichia coli
MTGKLCCRNVRAEEQSVFRRCPSLLSLTLMSALLSPLSLQAADVRRSGDEAFIIQQQRQEALEQQLMPSAPDVRLSAPGSFARKINFPVETPCFQIKQTELEGADALPHWLPLQKIANGAVGHCLGAKGINLLMSTLQNRLVDHG

SEQ ID NO: 470 - protein, 42 aa, Escherichia coli
MADLLLSILVPVDVGKYRKGGSVPLQKMVGGIVRRLVIVGMA

SEQ ID NO: 471 - protein, 252 aa, Escherichia coli
MSALLRRVEGGGDLGTANIAIVVLDEDNQPVAGVMYPSNVVKDGVVVDYLTASRVVARLKQILEQKQGCTLERAAIAVPPGISEGNTKVIVNVVELAGFIVTQVLDEPVAAASALNIKNGAVVDVGGGTTGMSILKSGKVTFSADEPTGGSHMKLVIAGALGLPYAEAEEMKKNGQEAQVFTLVLPVAQKMASLVSGWFATQQVKNIYLVGGASSFSQFANVFSKQTGKNVIPSAEPLLVTPLGIAMNADQG

SEQ ID NO: 472 - protein, 406 aa, Escherichia coli
MQSISGGIMSLACVLVINCGSSSMKFSVIPQDADQPLLSGLAERLGIDHAVITFKDRDGHKSTVALDDASHQHALKVLFAKLDEQQLLEAINAVGHRVAHGGSDFKRSVLVTDDVIEKVRALSVLAPLHNPANLIGIEAARALLPALPHIAVFDTAFHQTLSPAAYTYAIPLEFQQDYMVRRYGFHGTSHRYIAAEALASLDLDPADHGIVIAHLGNGSSLCAVQNGTSIDTSMGMTPLEGLVMGTRCGDLDFGVVAYLAKRTGQTFDTLYKMLNNQSGLMGISGLSSDCRTLQQARDEGHERAALAIDVLVHRLARHIGGHVTSLKRFDALIFTGGIGENSALIRELTVQRLQALGLELDKERNQQLFGGRSGLISKTDTTKIAVIPTNEEKMIAIDAAEIARTA

SEQ ID NO: 473 - protein, 83 aa, Escherichia coli
MLFLCARFLSIGNIEVVMQQEALGMVETKGLVSAIEAADTMVKSANVTLVGYEKIGSGLVTVMVRGDCWRSESRDRCGLRCCE

SEQ ID NO: 474 - protein, 261 aa, Escherichia coli
MRDNLVEQIISDVMNKQTDISPEAKTAANFAGCGITEFVGTALGHTIGLVIANVDNQLHEVMNIDKKYRSIGILGARTGAGPQIFAADEAIKATNSEIISIELARDTEGGGGHGCLIIFGASDVSDVRRAVEVALSEIERTMGDVYGSSAGHLEFQYTARASYALNKALGAPIGKSFGMTCASPAAIGLVIADAAAKSAVIDPVGYASPSQGTSFSNEVIFTFSGDSGAVRQAVIAAREVGLQLLSTLDPVEIKSTTTPYI

SEQ ID NO: 475 - protein, 99 aa, Escherichia coli
MKKRIINAPTPDILAMLKRRMPGEFRSRLDLIRIDAIGLLILPVPDLYFYADVASKSANVVVSEIFGSCPQHITTLAIFGEVAAVHEAMRIIEEDDNQF

SEQ ID NO: 476 - protein, 203 aa, Escherichia coli
MRKTITSFESPLMKKILLITGDFSEDYEVMVPWQALNMLGFRVDVVCPGKRTGEFIKTAIHDFEGDQTYTEKPGHLFRLTASFDDIRLQEYSGVYISGGRSSEYLRLNKSVLDIVHYAMNLTLPVAAICHGPQILAAAGVLKGRKLTGYFTVKPEVEMAGGQWVTAADDEAIVDGNLITATTWMGHPAILRHFITQMGTSIIH

SEQ ID NO: 477 - protein, 305 aa, Escherichia coli
MNKVEYETEGVIFNIQRYSLHDGPGIRTIPFFKGCPLSCKWCSNPESQRHSPELLFKKNDCIRCGKCIDACPQQALSTTNAWFINRDRCIQCGKCTEICPTRALEMKGKRMSVTAVMRELEKEENLYRRSGGGITLSGGEPLAQPEFARELLKACKAKGWHTAIETSGFTTKAVIDEVFPYVDLALTDIKAIDPEIHERNTGVNNRVILENLLRISFLTKVVVRIPVIPGVNDNSQEIHNIAEFARLMQNVDTIHLLPYHSFGENKYNLLGRQYPMGDTKSIEESQMAELKAMVESLGFNCHIGG

SEQ ID NO: 478 - protein, 301 aa, Escherichia coli
MNSLDIVVAFGGGIFGAAVGALAAFEFVGLLVIAMTVVQIITGASSDFITFPFGLFGPHTGGFAAGVAATAYAAKKGKLGSGRDITAGLSGLAAYDVLLVGGVFGAVGYIIAWGLNQIPAFPSGNAWTDTVALTVVISGVVSRLVFGKTGLFGKPEQGIRHCYPPQDKCWIPYHSRIPQLSVLGLGIGLMAGFLGLKFGGNGALLAFGISAFSLIFLHFNTQVPVSHHISLPAALVAVPSGSLIWAAIVGIICAILGELMSRIFLIHGDTHIDPPAMVITIMTTMINLLATIGLFTLVPLF

SEQ ID NO: 479 - protein, 62 aa, Escherichia coli
MWGFLTDCLVIPFVSPVTGVCIVAVLVYVSLCICTGSARFEKEYPLQITEALLSEPELFLLL

SEQ ID NO: 480 - protein, 383 aa, Escherichia coli
MNDYLFTSESVAEGHPDKMADQISDAILDAILLQDPWGKVACECLVKTGATIVAGEISTHAAVDIEKIVRNTIKEIGYDHSRLGFDGNTCCVLNILGKQSANIADGIRGHSMEELGAGDQGITFGYACDETSELMPATLVYAHRLMERQAQLRKSQRLPFLLPDAKSQVTLRYQDNRVHSVDTVVVSTQHSPDVSLDALREAVIEEIVKPVMPSHWLTPQTRFLVNPAGSFVIGGPVGDCGLTGRKIIVDTYGGAACHGGGAFSGKDPSKVDRSAAYAARYVAKNIVAAGLASRCEVQLGWAIGLPRPVSVRINTFGTQTVSSEALLRGVNSHFDLSVFGIITTLDLLVPRYRKTACYGHFGRDSFPWEVTDKAALLYEDVGR

SEQ ID NO: 481 - protein, 354 aa, Escherichia coli
MIQARNQLLAEAAKSPALNMVRPNGMNDEPQFQILIDDEKVQAFKLSMSDVDNIMSAAWGSMYVNDFNDRGRVKKVYIQGEPGSRISPQDFDKWYVRNSDGDMVSFASFATGKWIYGSPKLEQYNGISAVEILGEPAPGYSSGDAMKAIEDIAARLPEGFHISWTGLSFEERLSGSQAPALYALSLLIVFLCLAALYESWSIPFSVMLVVPLGVLGAVCATLLRGLGNDVFFQVGLLTTIGLSAKNAILIVEFARELHEKEGLSIKEAAVEAARVRLRPIIMTSLAFVMGVIPLAVSTGASSGSKHAIGTGVVGGMITATILAIFYIPLFYMLIAGFFSRRNKKSSDKTEAEQS

SEQ ID NO: 482 - protein, 41 aa, Escherichia coli
MKRVAMPALVLRKSALSPMLATLPLIFLLTPLVCQLFVIIS

SEQ ID NO: 483 - protein, 376 aa, Escherichia coli
MTGRKNKCVRKNCNNQVFSVKMAVEKRLCRKHYERFCELKKRREQNPVHRLNEALPRKVEGPKRKRKLVKEREIINSRTKHKQEQGPSLAELNKKVREILKTPAWRTLETRIRRNGITFNSKAELDALSELYAIYSWVSYCKRCDNYSVWFLNCPDVNINLHVCECRSSESDCYLPSRFIILPAPLRQKVKRKYSANSSGVSGHNDSKSLYKTVLSVCGGKRETELFFYSLPVKTNHHPYWIKSGVVKRFPPVFGLLFYEQERLTGGVFRYVLIRFYNTFKENLFFVEIVSCCFLVELFHDIDSFFINQRLSKLESFIDKWREGKEIWIKAYLQLIHNTLGITETEKLVNLYNSFFTDKVVIWDESVKKVKWIYEK

SEQ ID NO: 484 - protein, 226 aa, Escherichia coli
MSDDRSRHDRLAVRLSLIISRLMAGESLSLKTLSDEFGVTERTLQRDFHQRLVHLDLEYRNGRYSLRRQSSPCAIPEMLSFIQNTGIARILPLRNGRLITCLTDNQEPSPCLIWLPAPDITATFPECFSQLILAIRQCIHISLMTERWYPSLEPCRLIYYSGSWYLIALQKGKLQVFPLADIKSVSLTSERFERRGHIHSLVAEERFISALPHFSFIHKLINTFNL

SEQ ID NO: 485 - protein, 260 aa, Escherichia coli
MLNRKLNIRLRHSLNSHCIPSIIINNTVRSFQRSVMNTRALFPLLFTVASFSASAGNWAVKNGWCQTMTEDGQALVMLKNGTIGITGLMQGCPNGVQTLLGSRISINGNLIPTSQMCNQQTGFRAVEVEIGQAPEMVKKAVHSIAERDVSVLQAFGVRMEFTRGDMLKVCPKFVTSLAGFSPKQTTTINKDSVLQAARQAYAREYDEETTETADFGSYEVKGNKVEFEVFNPEDRAYDKVTVTVGADGNATGASVEFIGK

SEQ ID NO: 486 - protein, 120 aa, Escherichia coli
MMRAAKANYTYASFDAHLQKVAAMKPTMLLMITVFLIFPAISQAESPFSSLQSAKEKTTVLQDLRKICTPQASLSDEAWEKLMLSDENNKQHIREAIVAMERNNQSNYWEALGKVECPDM

SEQ ID NO: 487 - protein, 286 aa, Escherichia coli
MRTHPHLIKQTIDPRLINEINKRTQSNSEKLSNSDKLTYINDNYCEITRNYTSFYGMNMLSIVLFLPIVILCFASVLFFIYDITFNFERYLDTWRYRADSELMLHIAYCAIFFMSFVFAAILNYFIFAPRHYPIRFNRKTGKVYICDYILNDMSHKSTYTFWWHYPFYKHTKPEYKEYDWEQIQGIAFFAQNRHSSYSTIRCIVYESLDSTNIIDTFNLITTESAIDALHMTNHKLWLWINSFMNFDDEFLEKSINTAPGIWGREVNWPEDMNKKSMLSSMDEYIL

SEQ ID NO: 488 - protein, 56 aa, Escherichia coli
MLRIMAESVKQICLIAHIITGKNVPKYLKQAKFNALLKKKDKKKPHQNGGAKRIAS

SEQ ID NO: 489 - protein, 163 aa, Escherichia coli
MFKGLIMKLNLKGFFKAASLCSLAFALTGCITWGLVSNTASRPHAEQWRSDTIKGLSLAEDSNGTKGYVFVGESLDYLLTTGGDEVVKMLNDPAIHGERITVSDNAKFILSSSNKNFSGAITLYYDWNNEEDKALATQYGLICDTRALYMDAGRFERLNPPEK

SEQ ID NO: 490 - protein, 439 aa, Escherichia coli
MNGQIITVALILLGNSFLTPPVQAIGFDYYNDHGVMSYGKGYWGDKKIIAQFPEMNRADLRLVKNISGKTGYIPSDEISIKNESYHWMTDGRVILWRGKIVSNPPGTPTVDIASFQAMGRFAVDKYSLYFDGQRTESNSGASRVDLATLKAIEGNSTTLVDSKNLYLSGRRQGSSSNVTVLEKRWWGINPRLMSVNRNLYSNDLLIRSGQNIYLNGAHLTANADSFEIIRWIPHSLLVFRDNKGLHRYPFGQLSGKAIPVDDDVSFEVGESRVRWRKQLTPDRQWSQWIDLQGIEPEQFHLITDNIAQYKDRLYVTKLSTFGEDQLEIIPLDSPDLVIDHSFNRGKQHAYFIHQLRSRKSVQIIPTNNGPLTKNDRFAYDDRNVYTWTDTEVRITPSPCPAKTRVREENVHELHNRDIIIPVTDESCRNAAADGQTLKP

SEQ ID NO: 491 - protein, 499 aa, Escherichia coli
MIGTSRQDGFMHYRNVVCLLSCSLFLSSAWGCRLDEPEHNIYQKQGKGVVYLRPYEKTNLSLPQINYKRLRLLPNLLIDPTKLEDWETVPPATNLMTDVVYSGANATLPHYSYYSDGRAILYAGEIVQNPPGTPPVDISSFQAWGDFAADKYSLYYEGKRTDSNQQLNRRTLRQVEFNPQWKPDWLGLILRDKHYLYANGQRLDDPDTFTVLAQKSWDQRGKFSTAFNPCLPAPFGPWDTLARTQTKIMINGEQLDADPDTFSVVRWMPGSLFTWRDKNGLQRKVLDKENLAWDEDLTKHCLDFSLQEKKVFWRKGPACKQEELSGLDPEQFHPISDAVAQYQDSLYTIIETESGDRKLEIVKLDDPNLIINKRFNAGKRHGYLLTHAEGWVNHSSLHVFESDGPLILLDNRSPDEREAHLNDHPFLRRWYARDNRYVYSFDGAQLWRYRTADPKQVRLIWKEQHSGYGYGVNYKTGYLDGKITDDGEFIPAPRNEATK

SEQ ID NO: 492 - protein, 300 aa, Escherichia coli
MKKTLATLFLLTCLGSSSAYADNALILQTDFSLKDGAVSTMKGVAFGVDHNLKIFDLTHEIPPYNIWEGAYRLYQTASYWPQGSVFVSVVDPGVGTDRKSVVLKTKNGQYFVSPDNGTLTLVAESLGIESVRQIDEKTNRLKGSEKSYTFHGRDVYAYTGARLASGAITFEQVGPELPAKVVELSYQKAKATKGEVKGNIPILDIQYGNVWSNISDELLNQAGIKLNDTLCVTISEGSQQKYAGKMPYVASFGDVPEGQPMVYLNSLLNVSVALNMDNFAQKHQVASGADWNIDVKKCTK

SEQ ID NO: 493 - protein, 165 aa, Escherichia coli
MKRKLQKIILYLFLLCCIYNLWTLRPVQILYTYSDAGNSVFLVVDHLPWTDSDKINWYLKHQDEIKSQNPLPEGSWHTWYVIDIGNGFTDYKKYIEGPYEDLYCFPTIKSNDNCIVKNYLMVINEYPYRNTHFFIADNNEYQLTQENKIERVFNPHDFEKDNFQQ

SEQ ID NO: 494 - protein, 229 aa, Escherichia coli
MAFPDNYNRLFIPRQKTKDNNGLKTLNSKAVGRLLAAGGIYNGNIEGFRETANKLGGDAPAGYDQVMDNKGLLIAGASIVAGVVLGRMRFPDLESFEHFGARGAVSGRPFNPDLAGGPIENLTIDGVTINREGIAIVEKHISRFDHDPANDVMISRLKKIANKELLPEKYDLNYYTHECREYQRYCNLGWETGEPNGLDGYELWNNAHTATLEDFKIKDTDLFHPDAKK

SEQ ID NO: 495 - protein, 43 aa, Escherichia coli
MYSQRRVQFVIFTGQLQPQNFMADFTFPSSLSFLKREIILKFK

SEQ ID NO: 496 - protein, 502 aa, Escherichia coli
MSKKITSLFNFKKLQKFSSALMLPIAILPAAGLILAIGISFNIELLANCGGLIFANLPLLFCVGIVIGLTGDGSSSLSAIISYMIMNATMGTQLGITAESVAASNGDYAMILGVPTLQTGVFGGLIVAIFVYLLYTRFHNIELPQFLGFFGGKRFVPIITAVAAIIVGYLLPWLWIPVQKGLASLSTLVTSGHNANFAAFIYAVGERSLIPFGLHHIWNVPFYYNFGDYMTKSGQLVTGDIPVFFAQLRDGVPLTAGLFMTGRFPIMMFALPAAALAMYQEAKPERKALIKGLLLSGALTTFVTGITEPLEYAFLFAAPVLYIIHIFLYATSFVLMNILNVHIGHPFAGGLIDFVLNGVMPNRTPWYLVFLAGAGYAAIYYTVFRVLIRKLNLKTPGREDEEIAVATTLTREERPYQIIEAVGGFDNIEDVDACATRLRLALVDDKKVNEKRLKELGAAGLVKLGDGGVQVIFGGKSQILRDEIKTVMSRPRPTEMTVACAN

SEQ ID NO: 497 - protein, 665 aa, Escherichia coli
MNSQLLANAIRMLSVDAIQKANSGHPGAPMGMADIAEVVWRRHLRHNPKNPQWFNRDRYVQSNGHGSMLIYALLHLTGYDLSMDDIRDFRQLHSRTPGHPEYGYTPGVETTTGPLGQGVANAVGMAIAEKALAAEFNKPGFNIVDHHTWLFLGDGCLMEGISHEACGLAGTLKLGNLIAIWDDNGISIDGHVEGWFAEDTAARFRAYGWHVIEGVDGHDPEEVDAAVREAKSVTDKPSLLCCKTIIGFGSPNKANSHDCHGSALGADEVALVRERLQWPYAPFEIPGEIYAAWDATEKGAQVQQEWDALFADYAKQWPELAAEFTRRMKGDLPAGWVENMQKYVHDLQSHPAALATRQVSQKCLNHFADMLPELMGGSADLSPSNLTRHQKSVDFTGENPAGNYISYGVREFGMSAIMNGLALHGGFIPYGGTFLMFMEYARNALRMAALMKIRSVFVYTHDTIGLGEDGPTHQPVEQLASLRLTPNMETWRGCDQVEVAVAWQQAIERKDGPTSLVLTRQPLAQQPRTAAQLAEIARGGYVLSDCDGQPEMILISAGSEIELVVSAAKALTEEGRKVRVVSLPCTERFDNQDAAYKESVLPKAVRKRLAVEASIAGFWERYVGLNGKVIGMTSFGESAPANVLFKHFGFTPENVLAQARELLNS

SEQ ID NO: 498 - protein, 281 aa, Escherichia coli
MNNITVKSLIQSNYPTLHQAEKKVADYILSHAHEVVNYSVTELSEKSHASEATIVRTCKKLGYQGYYHLKIALAKEVINPDNSYPENTDFSDITSLATFLLKKQAEDLIQSTQFFNAEVLESILKLLANCDTIFFFAAGNSNPLAVYGAYKFSQLGLKTVVHVSPEMQINAAYSMGKRDLAIGISNSGSTNLMVDIFKVVKERGAKSVCITNYIKSPLSKLSTHQLNTAVSDKIFFEAFDSTRVPAMGVIDMLVLLFMYKNKAHYEKYRTREEFLGSRFKG

SEQ ID NO: 499 - protein, 301 aa, Escherichia coli
MFISDETLRVIHLVARHQSITTAAEQLNKVPSAISYTIKKAEESLGVELFIRKGRYIELSPAGSYFIEHSKTILGDLEALKRNTVLIHDGIERELTIAVNNIIPGDLLVAFIRDFERQFTSTTLTVDLEVYNGCWDALYSKRADLVYGAPHAVPSSEGIISEPVGQMEWDFVVSPLHPLAAKRHPLENSELRHYPAVCIRDTSVNFPPMQAWLLEGQKPIFVPDFATAIALIEQNVGIGYIPHHLALPLLNSGKLLKKPMREHKHATKLFLAARSDGMGKACQWCIEYLRNPQLMTQFVFN

SEQ ID NO: 500 - protein, 407 aa, Escherichia coli
MRKKEENLNTASGLRIAMILLGIAVTPVLLSSSSLGNQLSSSSLISVVLLGGVILTLLSAITISVGEKARLPTYGIVKYSFGEKGAIAINILMAISLFGWIAVTANMFGHSVHDLLAQHGLEVPLALLVAAGCVIFVASTAFGFTVLGKIAQVAVPVIALVLCYILYVATHTEVAVPAAIVEMNTGVAVSTVVGTIIVLVATLPDFGSFVHNRKHALIAAGVTFLVAYPLLYWAGATPSAISGQGSLLGAMAVFGAVLPAALLLIFACVTGNAGNMFQGTLVVSTLLTRFPKWQITVALGILSAIVGSMDIMAWFIPFLLFLGIATPPVAGIYIADFFLYRRNGYQESVLAQESQIKVLTFAAWIIGAAVGFMTVKGLFTLTTIPSVDSILVACIAYAILSRASQHR

SEQ ID NO: 501 - protein, 318 aa, Escherichia coli
MVKPLAVVAVGGNALIQDEQRNSIPDQYVAVMESVQHIVDMVEAGWDLVLTHGNGPQVGFILRRSELASNEVSPVPLDYAVGDTQGAIGYMFQKALHNELARRGINKPVIALVTQTRVSPHDDAFASPSKPIGAFLDEATAQQRQQQLGWTLMEDAGRGWRRTVPSPAPLEIIEHDTIAHLVRQGYLVIACGGGGIPVVRDGQQLKGVEAVIDKDLASALLASQLGADLLVIPTGVEKVAINFGTPQQQWLDAISVAEAQTLLREGQFGVGSMQPKVEAIVDFINASQQQGKQASGLITSPQTIKAALAHQSGTWITL

SEQ ID NO: 502 - protein, 491 aa, Escherichia coli
MGQHRCTDSVAEKGAKRMNTLFNQPLKVVNAGLHSFADNIQHAGGSAIALNWQPPAQGDIDAGLDLASLLCHPLVENANQIAMARYLEAQPVLVDVMLAKEAIPAMAEQKRILHSGPPIAWEEMCGPVKGAIIGAMLYEGWATSQQDAENQINAGEIDLAPCHHYHAVGPMAGIISPSMPLWVVENKTNGHRTFSNFNEGLGKVLRFGANNDEVLNRLAWMRDELAPAMKAAIAQHGELELKPLMAQALHMGDEVHNRNAAATGLLIKRLLPALLACSLPQEHIQRVVAFITGNDHFFLNLSMAACKAMMDAAANVPFSSMVTVMARNGVNFGIRLSGTGDRWFQAPANAVEGLFFPGFGVDDAAADLGDSAITETAGVGGFAMASSPAIVKFVGGTPVDATNNSRRMQAITLGGNPAFTLPALNFAPTAAGIDARKVTDRGILPVINTGIAHKQAGVGQIGAGITTAPMACFVAAVRALAEIVAKENHHG

SEQ ID NO: 503 - protein, 519 aa, Escherichia coli
MKVKYKVFSNLYQDSVSLMQISAQISKLPGIQQASVVMGTPNNLEQLRDAGLGNEINASPNDLVIAVMGEEDICNEALVLAQQRLTSKPDDETDSGIKTPEKVSLEMALEAEPEANLALISVPGDYAAAEAMKALNLGMNVMMFSDNVSIGQEKSIKTLARERQRIVMGPDCGTAIVNGIPLGFANVVKRGAIGVIGASGTGLQEVTCRIDQLGAGISQALGTGGHDLSEEIGGISMLFALDALAQDDETRVIVLISKPPSPIVARTILERAEACGKPVVVNFLGANPHDLARPNITAATTLASAANIAVALLNDQPLPAVETEISCDDLTMLQNACQRLPAHRQAIRGVFAGGTFCYEAQLICQQKGFSAASNTPVAGNRALANIWQSEDHTLIDMGDDDFTRGKPHPMIDPTLRNQRLLNELNDSHTAVVLFDLVLGYGASTTPASELLDQLSHIDMNNAPLLIAHVCGTEADPQIRSQQISALQNAGVIIASSNAQAALWASTVAQTQLQKKGLNV

SEQ ID NO: 504 - protein, 496 aa, Escherichia coli
MFESELLTQGFSTLLNNPQALLFATFGVMLGIVIGALPGLTATMGVAILLPFTYGMEPVSGLLMICGVFFGGVYGGSITAILLKIPGTPAAAATAIDGYELTKQGKAGLALSAATFSSFSGGTLSIIVLMFLSPVLASWALKFSASESFALATFGLSIIASISGESLIKGLIAGVGGLLIATIGLDPMGGFPRFTGGFVELMNVPFIPVMIGLFAASEAFRSMEQNQQIRRGAKVAIGSLLLPWQTLRRIALTILRSSGLGVFIGMIPGAGADIAAFVAYNETRRFSKTPENFGKGEIKAVASCEAGANGCTGGALLPMLTLGIPGDAVTAIMLGALTLQGMQPGPLMFTDHGDMVYTLFVGMIFCYFMLLVLGLLSLKVIGNVVKIPGNILTPMILALCVVGTYALNNSLFDVGIMLIAGVVGYFMQKGGYPASPVVLALIMGPMAESNFRRALSLSGGSLDFLYTRPITLALLTLAAFTLLTPIIRKIMRLRRQ

SEQ ID NO: 505 - protein, 169 aa, Escherichia coli
MMNTKQSVAQLAVPHRKRLSSTMVVALLLCVVAGAVMINAADFPATAIETDPGASAFPTFYACALIVLAVLLVIRDLLQAKPASCANAQEKPAFRKTATGIAATAFYIVAMSYCGYLITTPVFLIVIMTLMGYRRWVLTPGIALLLTAILWLLFVEALQVPLPVGTFFE

SEQ ID NO: 506 - protein, 324 aa, Escherichia coli
MIKHLTLPKKMAAMVLLAGAALSIAPVQAASYPTKQIELVVPYAAGGGTDLVARAFADAAKNHLPVSIGVINKPGGGGAIGLSEIAAARPNGYKIGLGTVELTTLPSLGMVRFKTSDFKPIARLNADPAAITVRADAPWNSYEEFMAYSKANPGKVRIGNSGTGAIWHLAAAALEDKTGTKFSHVPYDGAAPAITGLLGGHIEAVSVSPGEVINHVNGGKLKTLVVMADERMKTMPDVPTLKEKGVDLSIGTWRGLIVSQKTPQDVVDVLAKAAKETAEEPAFQDALQKLNLNYAWLDAASFQTQISEQEKYFDELLTRLGLKK

SEQ ID NO: 507 - protein, 209 aa, Escherichia coli
MPFNTLLQKTGLVAILRGVKPDEIVAIGEKLYAAGFRLIEIPMNSPEALQSISILRDALPKDCLVGAGTVLSVEQVVAVKEAGGQIIVMPHCDTAVIRRARALGMYCAPGVATPTEAFAAIEHGANAIKLFPAEQITPEVTKAWRAVIPQSVPMLPVGGITPETMARYLSHGANGFGLGSALYRPGMTPEQVYENAVLFMNAWNNLNSN

SEQ ID NO: 508 - protein, 262 aa, Escherichia coli
MSIIEVTGNPRHDQLVHLIAERGYMNIEELAQLLDVSTQTVRRDIRKLSEQGLITRHHGGAGRVSSVMNTAFEQRELSLTAEKRAIAEAVADYLPERCTVFITIGTTVEAVARALLNRRDLRIITNSLRVAQILYKNQDIEVMVPGGTLRAHNGGIIGPGAVDFIEGFRADYLITSIGAIEHDGTLLEFDVNEALVARTMIKHARNTLLVADHTKFTASAAVSIGNARNVRAFFTDAPPPNSFCQLLSEENVELVVAEQEVS

SEQ ID NO: 509 - protein, 315 aa, Escherichia coli
MSFKLTKDDKIKQDKTNMTRIACVGITVQDRIYSLPTLPEGGGKYQANHYLEIGGGPAATAAVAIAKLGVEVDFIGRIGDDSCGNTLLAELEGWGVNTAFCRRYPNARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 510 - protein, 359 aa, Escherichia coli
MIPTHAILVIFVLSCLILSSLVNLNDTNDQISDACRVFEHKLQICSKTDENEFSIVIILSMSDRRVFMATIAFLGLGQMGSPMANNLLQKGHSLQVFDVNTQAVDALVTQGATAAQTPAEAAASAEFIITMLPNGDIVRQVLLGEKGVCETVSSDALVIDMSTIHPLQTDALIRELQEKGINMMDAPVGRTSVNAIDGTLLILAGGTDEQIARARPILMCMGNELVEAGGPGMGIRVKLINNYMSIALNALSSEAAVLCESLGLNLDVAIKVMSGTAAGKGHFTTTWPGKVLKGDLSPAFMVDLALKDLRIAVDVARKTGAPLNMGIAAESYYAAASQDGKGRQDWSALLNQVRQQAGL

SEQ ID NO: 511 - protein, 295 aa, Escherichia coli
MSSHFTPFTLKDISRPGGGFAMLAVDQREAMRLMFAAAGQPKPIADSVLTDFKVAATRILSPYASAVLADKQFCLEQIVEQGAVANSCGLIVAADLFIPGNGIPVDSVEIDMSVDPHKAREMGAKAMKLLVLWREDEPAEERLAMVDKFVRRCRSAGLVSIIEPVVRPPRRGWDFDRESAIVAAAAELGGTEADLYKAEMPLGGKGDEKTLLAACQQLNDQMKMPWVILSSGVDADIFGRAVSIAMKGGASGFLAGRAVWASVVGAQDPQTMLRDVSVPRLQRLAEIVDEGIAQR

SEQ ID NO: 512 - protein, 336 aa, Escherichia coli
MDKITQVLFSDIGKVTTQYVEVPHQQLKPHEVRIAPVFYGICGSDLHVLKGGHPFAKPPVVPGHEIAARVTEVGSDVKNVQPGDHVVVDPIMACMECRACKAGRFNLCEPPQVAGFRAPGFARSQHIVPARNCHVAPASLPLKVLAFAEPAACARHCVNRMPKASLESVLVIGAGTIGLSIVQALRIMGAGKITVIEPDAAKRALALKLGAAEVWAPGELAADVRFTGAIDVVAAQATLNDACTRVYAGGTVVCMGVPSGPREIPLPMMQRFERDLLNSGMYIPEDFDAVIEWLADGRFDTSELVTDLFAIEDAAAAFERAQQNDSIKVMLQFAPE

SEQ ID NO: 513 - protein, 477 aa, Escherichia coli
MSQITSPATYSISRPQDVIDIVNKNSAINTSIGVIFIALGGILIDAYQAAMVGFGNKYIAAQFGISPGLAATVNASVLIAALIGGLLANRVINRFGQKRAFIIGMGLCTIGAAAVAIAPSIWWVLVCRVIMGFGLGIDFPLATNAVAELRGSTSKKTGTSVNLWQMAWYVSTTVVYLVLLPLLLSGIAEEQLWRYGIFIGAIFAVIFMILRYFFIGESAMWAARVGRYQEACDILGKRYGVQARVAASGTTEAKFSEKAENKYSGGYGILFNDRYRKRTILGCVVATMQAWQYNAVGVYLPLTLAGIISGGLTGALTGSAVVNALCGVTGGMIGSFILQRLGTRRQSMYGFAVVTLALLSLGALATTNPWLSLGLLGSIIFFHSAGPGGLGMTIATLSYPPAIRPTGVGFARAIMRTGAIAGLIFWPMLWGALKTEAFYWLAIVPFLGFLTCVLINWEPLGANVDAEDAEVLAELKK

SEQ ID NO: 514 - protein, 449 aa, Escherichia coli
MSEKLPAPREGLSGKAMRRVVMGSFAGALMEWYDFFIFGTAAGLVFAPLFYPDSDPFIGLIASFATFGVGFLTRPLGGIVFGHFGDKIGRKITLIWTLAIVGCSTFLIGFIPTYQEIGIWAPLILMVLRLIQGFGLGGEYGGAALMTIESAPESRRGFLGSLPQTAASVGIMLATGIFALCNHFLTSEQFLSWGWRIPFWLSAVMLIVGLFIRLHTEETLDFQKQKTTNNKEKSVPPLIELFKKHPRNILLALGARLAESVSSNIINAFGIVYISSQLALSRDIPLTGMLIASAIGIFSCPLVGWLSDRIGQKSLYLSGAGFCVLFAFPFFLLLDSKSTLIIWCSMILGYNLGPTMMFAVQPTLFTRMFGTKVRYTGLSFAYQFSAILGGLSPLIASSLLALGGGKPWYVALFLFAVSVLSFVCVWLIEPTDEQETASYRYIREQSHEN

SEQ ID NO: 515 - protein, 457 aa, Escherichia coli
MKKSTLSLAIGLLLACSTGMAKTQHLTLEQRLEAAEMRAAKAEGQVKQLQTQQAAEIREIKTAQGNTPVNGQSTTESEKKNATPPNLLLSGYGDLKIYGDVEFNMDAESNHGLLAMTNADVNSDPTNEQWNLNGRILLGFDGMRKLDNGYFAGFSAQPLGDMHGSVNIDDAVFFFGKENDWKVKVGRFEAYDMFPLNQDTFVEHSGNTANDLYDDGSGYIYMMKEGRGRSNAGGNFLVSKQLDNWYFELNTLLEDGTSLYNDGNYHGRDMEQQKNVAYLRPVIAWSPTEEFTVSAAMEANVVNNAYGYTDSKGNFVDQSDRTGYGMSMTWNGLKTDPENGIVVNLNTAYLDANNEKDFTAGINALWKRFELGYIYAHNKIDEFSGVVCDNDCWIDDEGTYNIHTIHASYQFANVMDMENFNIYLGTYYSILDSDGDKIHGDDSDDRYGARVRFKYFF

SEQ ID NO: 516 - protein, 286 aa, Escherichia coli
MYIKKHWIALSILLIPCIGNAQEIKIDESWLHQSLNVIGRTDSRFGPRLTNDLYPEYTVAGRKDWFDFYGYVDLPKFFGVGSHYDVGIWDEGSPLFTEIEPRFSIDKLTGLNLAFGPFKEWFIANNYVYDMGDNQSSRQSTWYMGLGTDIDTGLPIKLSANIYAKYQWQNYGAANENEWDGYRFKIKYSIPLTNLFGGRLVYNSFTNFDFGSDLADKSHNNKRTSNAIASSHILSLLYEHWKFAFTLRYFHNGGQWNAGEKVNFGDGPFELKNTGWGTYTTIGYQF

SEQ ID NO: 517 - protein, 541 aa, Escherichia coli
MRMKTAQRTLFAATLLTIFSTSVMAQDVTIIYTNDLHAHVDSYKVPYVADGKRDIGGFANISTLVKQEKAKNKATFYFDAGDYFTGPYISSLTKGEAIIDIMNTMPFDAVSIGNHEFDHGWDNALRQLSKANFPVLLGNVYHKESEKPFWNKPYTILEKDGIKIGIVGLHGVFAFNDTVSELSLQGLDNDNNNRFDKSSATLKNQGIEARDEVKYLQHYIDELRDKVDLTVALVHEGVPARQSSIGNTDVRRALDKDIQTASKVKGLDILITGHAHVGTPEPIKVGNTLILSTDSGGIDIGKLILDVNPTARTHKVKSFELKTVYADEWIPDPTTQKVINGWNKKLADLVRQPVGESSIALTRAYGESSQLGNLFTDAMLVAAPTAQIALINSGSLRADINAGTITFGDITSTFPFKNELTEMDLSGKDLRNLLEHGASLTNGILQMSKGAEMRYTLQKPVGQRIVSFKINGEEIVDTNIYHVATTTFLALGGDGFLAFKEGKNVQVRAGNNMSNVVIDYFKKGHKITPAQVNEMRVEVSK

SEQ ID NO: 518 - protein, 517 aa, Escherichia coli
MMKTVFTTLSVIFGVIFSHSVLAQDVTIYYTNDIHAHVNPAKIIAVDKNRLIGGMANIAGIVNEAKKKSKDVFFFDAGDYFTGPYISTLTKGEAIIDIMNTMPFDAVSVGNHEFDHGVPNMVSQLSKAKFPILLGNIYYTDTNKPVWDHPWTIIEKDGLKIGVIGLHGAFAFYDTVAAKAREGVEARDEIKYLNKALAELKGKVDITVLLIHEGVPARQSSFGSKDVERLLQADIETAKKVNGVDVLITGHAHVGTPQPIKVNNTLIVSTDAYGTNIGKLVLDYNPKTKKIDSYNGELITIFADQFKPDTIVQNTIDKWSAKLNKITKEVVGHSPVVLTREYGSSSSTGNLILDAMMEKTPDAVAGFQNSGGMRADFPKGDITLGDVISTFPFNNDLIEMDLTGRDLKSLMTHATNLTNGVLQVSKSVAVVYDSKKPLNQRLISFTINGKPVEDNQTYRIATHSFCASGGDGFEAFLNGKNVKTIPGTTSAESIIDYFKNHKPVTPDLTKRVMDVAK

SEQ ID NO: 519 - protein, 519 aa, Escherichia coli
MFMKIKILAAGIALTLPFWACAKDVTIIYTNDLHAHVEPYKVPWIADGKRDIGGWANITTLVKQEKAKNKATWFFDAGDYFTGPYISSLTKGKAIIDIMNTMPFDAVTIGNHEFDHGWDNTLLQLSQAKFPIVQGNIFYQNSSKSFWDKPYTIIEKDGVKIGVIGLHGVFAFNDTVSAATRVGIEARDEIKWLQRYIDELKGKVDLTVALIHEGVPARQSSMGGTDVRRALDKDIQTASQVKGLDILITGHAHVGTPEPIKVGNTLILSTDSGGIDVGKLVLDYKEKPHNFTVKNFELKTIYADEWKPDQQTKQVIDGWNKKLDEVVQQTVAQSPVELKRAYGESASLGNLAADALLAAAGKNTQLALTNSGGIRNEIPAGAITMGGVISTFPFPNELVTMELTGKQLRSLMEHGASLSNGVLQVSKGLEMKYDSSKPVGQRVITLTLNGKPIEDATVYHIATQSFLADGGDGFTAFTEGKARNITGGYYVYHAVVDYFKAGNTITDEQLNGMRVKDIK

SEQ ID NO: 520 - protein, 427 aa, Escherichia coli
MDVDVSTSVAGNKPQRIRRIQTVTLVLLFMAGIVNFLDRSSLSVAGEAIRGELGLSATEFGVLLSAFSLSYGFSQLPSGILLDRFGPRIVLGAGLIFWSLMQALTGMVNSFSHFILMRIGLGIGEAPFMPAGVKSITDWYAQKERGTALGIFNSSTVIGQAIAPPALVLMQLAWGWRTMFVIIGVAGILVGICWYAWYRNRAQFVLTEEERTYLSAPVKPRPQLQFSEWLALFKHRTTWGMILGFSGVNYTGWLYIAWLPGYLQAEQGFSLAKTGWVAAIPFLAAAVGMWVNGIVVDRLAKKGYDLAKTRKTAIVCGLMMSALGTLLVVQSSSPAQAVAFISMALFCVHFAGTSAWGLVQVMVSETKVASIAGIQNFGSFVFASFAPIVTGWVVDTTHSFNLALVIAACVTFTGALCYFFIVKDRIE

SEQ ID NO: 521 - protein, 388 aa, Escherichia coli
MIEHYIRGFEEELREIRHQIHENPELGLQEFKTSALVAEKLRQWGYEVEQGLATTGVVATLKVGDGEKSIGLRADMDALPIYENSGKPWASKHPGLMHACGHDGHTTILLGAARYFAETRRFNGTLRLIFQPAEEMINGGEIMVKEGLFDRFPCDVIFGMHNMPGLPVGKFFFQPGALMASMDQFHITVRGCGGHGAIPHKAIDPVLVAAHITTALQSIVSRNVDPLEAAVITVGSIVAGEAANVIPDSAEMKISVRSLSRDTRQLLLTRIPALAQAQAASFGATAEVTHVNGTPVLVNDEEMARFAWQVACKTFGEDRAEFGIKPLMGSEDFSFMLEAQPKGGFLLFGNGDVGEGSCMVHNPGYDFNDASLVPASSYWGALVEAWLQ

SEQ ID NO: 522 - protein, 438 aa, Escherichia coli
MTAIVNETVSVKKKPSGRRVIFASAFGNALEFFDFGVYNFFVVYISTLFFPPSADHNVALLLAFATFGVSFFMRPLGGIIVGAWADRFGRKPAMVFTIALMSLGTLMIGIAPTYETAGYWGTATLVLARLIQGVAAGGEVGASMSLLVESAPANRRGFYSSWSLATQGLATTFGGVVALGLSAWLPFATGSETVMAEWGWRVPFFIGVLLAPIGCWLRLSLENDVPEPVRNKKAATSESAFSLLLQHKATIVNGVLLAIGSTVATYISLFYYGTWAAKYLAMPQHYSHAAMLLAGVITFVGALLVGMLCDSVGRKKLILISRVMVLLCSWPSFWLLVNYPSPGMLLTVVFVMVSFTTLGGVPVMLLISELLPKRIRALGFALVYSIGVAIFGGFAQYFATQSIVLLDSLTAPAWYLGGGTLLSMLALLYVKEPAKELQ

SEQ ID NO: 523 - protein, 149 aa, Escherichia coli
MQRQYKKYILLFWGVMDVIAIATYLFYSLGNGRIPFYSDIVHSLSLLKDIGVEGGFYAYAVATVTLQIVLLLSLFFSAQCFLRQKLFSFSFLAIQEVMRFATVSCSISVIPLLLNYFHSQNLVLNISLFIFSEVTKVTTIIWCKRQGKV

SEQ ID NO: 524 - protein, 284 aa, Escherichia coli
MTNLMINGAIMEQRKITRSDLVSMFLRSNLQQASFNFERIHGLGFCYDMIPAIKRLYPLKEDQVAALRRHLVFFNTTPAVCGPVIGVTAAMEEARANGAEIDDGTINGIKVGLMGPLAGVGDPLVWGTLRPITAALGASLALSGNILGPLLFFFIFNAVRLAMKWYGLQLGFRKGVNIVSDMGGNLLQKLTEGASILGLFVMGVLVTKWTSINVPLVVSQTPAADGATVTITVQNILDQLCPGLLALGLTLLMVRLLNKKINPVWLIFALFGLGIIGNALGFLS

SEQ ID NO: 525 - protein, 265 aa, Escherichia coli
MEISTLQIIAIFLFSCIAGMGSVLDEFQTHRPLIACTVIGLILGDLKTGIMLGGTLELIALGWMNVGAAQSPDSALASIISAILVIVGQQSIATGIAIALPVAAAGQVLTVFARTITVVFQHAADKAAEEARFRTLDILHVSALGVQALRVAIPALIVSLFVSADMVSNMLSAIPEFVTRGLQIAGGFIVVVGYAMVLRMMGVKYLMPFFFLGFLAGGYLDLSLLAFGGVGVIMALLYIQLNPQWRKAEPHPQTTTITALDQLDD

SEQ ID NO: 526 - protein, 268 aa, Escherichia coli
MQTWLNLQDKIIIVTGGASGIGLAIVDELLAQGANVQMVDIHGGDGQYESHKGYQFWPTDISSAKEINHTVAEIIQRFGRIDGLVNNAGVNFPRLLVDEKAPAGQYELNEAAFEKMVNINQKGVFLMSQAVARQMVKQHDGVIVNVSSESGLEGSEGQSCYAATKAALNSFTRSWSKELGKHGIRVVGIAPGILEKTGLRTPEYEEALAWTRNITVEQLREGYTKNAIPIGRAGRLAEVADFVCYLLSERASYITGVTTNIAGGKTRG

SEQ ID NO: 527 - protein, 721 aa, Escherichia coli
MVRLLRLSLLQKHAIVILMILPTLKRSAFPNITRLRAPTMTHNVSESIIDSLTDVKMPHYAPLAQVSGSIDLNGTILPEYRCNTLVLGSGAAGWRAAVELKRQNVDVMVASSKAFWGTSACSGSDKQTLHTANTRANGDHFLTLSNTLAAGGAMDHDTAYVEALGSVNTCEVLKYLGLDLPEDLFGATLRYQTDHDEFGRATSCGPRTSRLMVKVLAQEAMRLNIPLCDHTTAIRILTSGEGENRRVEGVIAIDKACRDNPWRMVVIRCQHLVLATGGPGELYRDSVYPVNCFSALGMALEAGITLVNLTESQFGIGTPRSQFPWNLSGTYMQAMPRIYSQDHSGRQYNFLATYYPTTRMLASAIFRKGYQWPFHAERMLEYGSSLLDVAVYEETQKGRDVFLDFLREPEPAADGTLFNLRELDDDVIDYLQQNHALLAQPLARLTQMNPLAIRLYQMHGHDLTASPLKFTLNNQHLNGGIEVDIWARTSLTGCYAAGENAGTHGVTRPGGAALNAGQVFARRCALHIAHQKSQDRPLERQQILSTINEAQQHLNQGLLRDDVRETIQNTMSHHAAILCHTQGINTAAQTLATLCEDIRREGIQCDENSLAQSFQWRQSAQLALAVLRSLQCYVENGGGSRGARAIYDGEAGIAPQTPGGPLLAWRFRPENQDARQYMICVCREANDYQTWTRPCRERGVLTLTNFERQWQNWIAATPFQY

SEQ ID NO: 528 - protein, 466 aa, Escherichia coli
MQPSQPAEKANVSSADLRRAAWTCSLGSALEYYDFALYSLASAIIFGPLFFPNQEPGMALIASFGTYFLGFAVRPVGGILFGSLGDRLGRKFVLLATVLLMGIASTLIGVLPTYETAGIWAPIMLIALRLLQGLGAGAEQAGAAVLMTEYAPDGKRGYYAALPFLGIQIGTFMASAVYFILLHNVTNLAETWWWRLPFLSSVVIIAVAIYIRLHLKESPSFAKLEARQQVTESPLRNLLKTSRRNVFVGIGLRLAENGGSSIYQALAISYIVGVVGLDKSVGTLCLMSAVVVGAIMVPIAGWLTDRFGRVLVYRSLAIFQLLITFPVWWSFSHGNVPVTIVSLSLALGIGAWGMFGAQGAFLPELFGARHRYIGVALAREVSAVIAGGIAPLVGSAIISWVIHTNDPSGIAAWMPIAIYLSLLTVGTIIATFFAPETRDRDLDDLADAETISVSQHNQTTGTYHDA

SEQ ID NO: 529 - protein, 259 aa, Escherichia coli
MNNGTIDLQRNGFIATLVINRPAKLNALTPEMLEQLLAHCHTLETDSEIRVVLLTSASEKAFCVGADIHRWTSLSALDMWRNWIRRGHQAFDALAQLPQPVIALLHGLAYGGGLELAATADIRICSAEAQMALPETGLATVPGWSGTQRLTALLGRSLVKELVFTGEPLDAQRALSCGLVNRVVARETLHDAGLQLAQRIAQRAPVAVQIAKQVIDAGEGIAVASTLEALAGAFSATTEDAHEGSQAFTEKRQPHFSAR

SEQ ID NO: 530 - protein, 246 aa, Escherichia coli
MQVVSQSAAVNQNSCRLHLYSFFSGSAHQCKTSLNRYDRSMLFHIQGWVYKRQDDIGFSAMTKIKFVFFFLLIAGITPAATGACPVQTPDGVADKFYSTYVFSDTGFKSEKDQLAFFQNYLTPSLYQLIVGAYDRNKRDYAIDPTAKPTFGDGIIFTSYPSDSYYEKFDGVTLPSSFKPGDNNVTVTLHFHFSVDDKKAWQDEALMARSADDGCWQIDNIIFHEDEDNSVLSLKEWLKKGIESPAE

SEQ ID NO: 531 - protein, 185 aa, Escherichia coli
MSYSEIAACLAYAVSVWLAARNNVHTWWIGIIGSILYGWVFWSVQLYADVTLQLFFIATSITGWIHWLKGQGGDILPVRRTQASHFFLLLLCAVVVAGGYGFLLHTFTNAWAPWLDSLILTFSVLAQFMLMGRRIENWFVWLAVNTLAVPLYMTRGLNLTAGLYFLFWINAWHGLYQWRKELQTS

SEQ ID NO: 532 - protein, 472 aa, Escherichia coli
MSTIFDVAVMGGGPGGYVAALRAAQNGLSVVCIDDGVNAQGEPSPGGTCLNVGCIPSKSLLQSSELYAQVQHEASIHGVNVDGVSFNAAAMIQRKDAIVSRLTMGIGLLFKKNKVKYLCGLATLEHARDEIWQLRVNDQQIRARNVVIATGSQPRQLPGVTIDNQQILDNRGALALTAVPPRLGVIGAGVIGLELGSVWNRVGSDVTLLEMAPTFLPALEARLSNEVRKAMIASGMKMQLAVEIEAIEQRDDGVHVRWRQGEKREESRFDKLILAIGRVPRLSGVDLVQLGLEADNRGGIAVDNLCRTGKAGLWAIGDVVRGPMLAHKAMAEGVVVADQIAGLAVEPINFALIPSVIYTQPEVAWVGENEASLKAAGRVFNKGNSLFAGNGRALALGQEGGRCTLYSDKHTDRVLGGAIVGPQASELINEIALAMTFSASGEDIACAIHAHPTLSEVIHEAAMALNNKALHG

SEQ ID NO: 533 - protein, 389 aa, Escherichia coli
MNLHEYQAKSLLAGMGMPCPKEIAIQQISQLADAWQHIACPSKGAVLKAQVHAGGRGKAGGVKVLKQLPEAQAFVQQMLGSQLVTYQTGPEGQYVSSILLCENIYPVRQELYFGMVVDRESQRVTFIVSPEGGVEIEKVAHETPEKISSVSIDPLTGVQPCHIREMFAVLQLEHGLFAAFSRLVNQAWKAFNELDFALLEINPLVLRETGEFMCADAKVSLDDNALYRHPELQVLRDETQEDPRESQAAKLDLNYVSLDGNIGCMVNGAGLAMATMDIIKLYGEQPANFLDVGGGATQERVSEAFRLIVSDSKVKAILVNIFGGIVRCDMIARAIIHALNEARITLPVVVRLSGNNAAEGQRLLAESGLTVEAVNSLDDAAKRIIALLN

SEQ ID NO: 534 - protein, 290 aa, Escherichia coli
MSVLINKHTRVLVQGITGKNGTFHTEQAIAYGTQIVGGVTPGKGGQRHLDRPVFDSMKEAMRQTEADASVIYVPAPFVLDSVVEAIEAGVKLVVVITEGVPTLDMVKVRRLLDCHPDVRLIGPNCPGVITPGECKIGIMPGEIHRPGRIGIVSRSGTLTYEAVAQTTALGLGQSTCIGIGGDPVPGTNFIDALRLFENDPQTDAVIMIGEIGGNAEERAAEFIRHEMNKPVVGYIAGVTAPKGKRMGHAGAIISGGSGSAEDKFRAFDKAGMAWTRNPALLGETLWNVIK

SEQ ID NO: 535 - protein, 501 aa, Escherichia coli
MNMSSISHGAPQKRRIIPNPGLWLAIIAGIIITLLPLGDTLPVAGQNMIAILVFAIIVWISEAMDYTASAIVISALIIFMVGFAPDMNHPDTILGTAKALKMTLSGFSNSALALVAAAMFIAAAMTITGLDKRIALFTMSKIGASSRSIIIGAIVVTIVLSLVVPSATARTACVVPIMMGVIAAFKVDKHSRLAASMMIVIAQATSIWNVGIQTSAAQNLLSIGFINKTFGAGHSVSWLDWLLAGAPWSLTMSVILYFLARKLLPPETEAVEGGSEAIKKALAELGPTTGKEKRLIGISLLLLLFWSTGGKLHSIDTTSVTLAGLAIMLLPGIGVMSWKEVEKRVQWGTLLMFGIGISLGSTLLDTQAASWMANYVVKGFGLDGLPSLAIFAILAAFLIIIHLGFASATALTAALLPILISLLSSLPPELGVNPVGMTILLAFSVSFGFILPINAPQNMVCMGTDTFTPRQFTRVGLYLTVIGYLLLLLFAATWWKILGLM

SEQ ID NO: 536 - protein, 606 aa, Escherichia coli
MKISWNYIFKNKWRFHITSISLFLIMLAVSIAFLHLRFNTLSSTDKMRLEMYKSTLYSTIEQFYVLPYMLSTDHIIRQAVITPDDMTSSELNQRIAHFNTQLKTAAIFILDTQGKAIASSNWQDPGSYVGQNYSYRPYYKHAMSGLNGRFYGIGSTTNTPGFFLSTSIKDKGKIVGVVVVKISLNEIEKAWAEGPENIIVNDEHGIIFLSSKSPWRMRTLQPLPVQAKQKLQSTRQYSLDNLLPADYYPCYTVSNFTFLKDKKEQLCLFPQYYTQQIAIPEFNWKMTIMVPLDNLYWSWAISLVITLIIYLLFLLFIKYWRMRSHAQQLLTLANETLEKQVKERTSALELINQKLIQEIKERSQAEQVLQITRSELAESSKLAALGQMATEIAHEQNQPLAAIHALTDNARTMLKKEMYPQVEQNLKHIISVIERMTQLISELKAFASRHRVPKGSADVIKVMYSAVALLNHSMEKNNIERRIKAPSMPLFVNCDELGLEQIFSNLISNALDSMEGSSYKRLDIAIRQANNKVIITIKDSGGGFAPEVVDRIFEPFFTTKRRGMGLGLAIVSEIVRNSNGALHASNHPEGGAVMTLTWPEWGEEHE

SEQ ID NO: 537 - protein, 50 aa, Escherichia coli
MVYRTGIPNVIMLFLCDKSADNPSFPPRLALWSDGFFNKRTIISFNLLTI

SEQ ID NO: 538 - protein, 44 aa, Escherichia coli
MQNTKMKHSVCFMNFVNYITIGCLLARLGRDFYCRTDYVFFQRH

SEQ ID NO: 539 - protein, 294 aa, Escherichia coli
MDIRTLRYFVEVVRQQSFTRAAEKLFVTQPTISKMLKNLEDELNCILLIRDGRRLLLTDTGRVVFERGLALLAEFRQLEAELSDINQLKTGVLRLGIPPMVGMLMAGPIGLFRQRYPGVELKISEFGGLTVQQAVMNGELDMALTALPVEESGLTTLSLFSHPLCVLTPHSGKWLECDAVSPETLAEHPLLIYNEDFALSKQLMKLFDEHGVKPRIAVRSGQWDFLAAMVQAGVGIAILPEPICQRLDKNTLKWLPLESELSWKLGMIWREGVYLSHSAHAWLSCCEGYWLTPV

SEQ ID NO: 540 - protein, 42 aa, Escherichia coli
MTIPAMILIHFSQGRALSILTILFYFQDILSCPWRFAALPLP

SEQ ID NO: 541 - protein, 134 aa, Escherichia coli
MALRRITPAVVQSIQVFFQVVLYAGLFIFAQYLVSWLHLPLPANLVGMILMLALIVCRILPLQWVRAGARWLLAEMLLFFVPAVVAVVNYAQLLLVDGWRIFAVIALSTVMVLGTTAWVVEKVYRYEMRRLNRG

SEQ ID NO: 542 - protein, 229 aa, Escherichia coli
MANFQLSMLCLAITLVIYFLNKRLYRRFRKLPLMPLVLTPTLLVMLLVFGNISWQNYIGEAHWLLWLLGPATIAFAVPVYDNRAIIKRHWMSLTAGVLTATVVAVTSSVWLARLFTLPDEIQRSLAVRSVTTPFALAASQSLGGQPDLVALFVVVTGVFGMAIGDVLFLRLSIREGMAKGAGFGAASHGAGTARSYELGQQEGVVASLVMMLSGVLMVLVSPLVARMMF

SEQ ID NO: 543 - protein, 298 aa, Escherichia coli
MPVWPLICWVMACAMFWSLNMTDSRLSINNLCVDYPESRVVNNVSFTLGNERLALVGESGSGKSMTARALMGLVRKPGVVTADTLNILGRDALTLNARGWQQLRGNDIAMVLQDPRYALNPVKTVKAQLEEALTLHQRLNRREKEEKINTAIQAVGLNTRVLQSYPRELSGGMGQRVMIAIALINDPRVLIADEPTSALDVRLRNQILELLVTQCEQRQMAMLLISHDLPLVAQFCHRVLVMYQGNKVDEMHAAALPTATHPYTRTLWTCRPNAQTYGQMLPTLDRTAMTPEKYHDDC

SEQ ID NO: 544 - protein, 277 aa, Escherichia coli
MPMFLFLRRLRHSPAAFCGLIIILLLMLIALFAPWLAPHDPNWQDAAARLQAPSRQHWLGTDSYGRDLLSRLIYGSRPALGLVALVTIITLPVGLLIGILAGYYGGWLERVLMRFTDVVMSMPRLILAFAFVAMLGPGLVNGALALALTTWPAYARQARSEIQRLRHSDYLAAAEMMGIRGRRLLAGHILPLCLPSAIVRLALDLAGIILAAAGLGFLGLGARPPMAEWGAMIADGMQVIFDQWWIAAAPGAIILIASLAFNLLGDGLRDVLEPQHD

SEQ ID NO: 545 - protein, 380 aa, Escherichia coli
MQLASSHVTGRGTRAGLYCRPAADLSLYGKIMSVVFSTRARWRGKRPLLALLQGLFTVALTLLGLLLITFALSALSPVDRVLQIVGDHASQSTYDQVRHQLGLDQPLAVQFWHYLMNLAHGDLGIASSTGQPVLQDLLSAFPATIELATLALIVGAVVGVIAGVLCARYVGSPLDFTVRTLTLLGNSVPVFWLGLLMLALFYARLQWSAGPGRLDDIYQFTIEPRSGFALIDTWLSGDREAFTNAINHLILPVLLLAYFSLASITRLTRSACLGEMNKEYILLARAKGASEMTILLRHVLPNIRGTLLTVIALAYTSMLEGAVLTETVFSWPGIGRYLTTALFAGDTTAIMGGTLLIGVCFVLINNLTDLLVRLTDPRLR

SEQ ID NO: 546 - protein, 522 aa, Escherichia coli
MIKKLLPLLVLSTISATTVAATPPNTLVVAQGLDDIVSLDPAEANELSSIQTVPSLYQRVVQPDRNDPTKITPILAESWQADPAAKTLTIKLKSDAKFASGNPVRPEDVIYSYVRAVTLNKSGAFILNVLGWQPENIASQLKKIDDHTVQVQWSADVSPALALNILSTPIASIVDEKLVAPNAKNNDFGNEWLKMHSAGSGAFKMRTYQPHQAIVMEANASSPTGAPKLKNVIIKNVPDPATRRLLIQQGDADMARDLGADQIDALQGKPGVKVMSIASAEQNYLAFNTGNKDNPLMSNPAFWEAARWLVDYDGITKNLLKGQYFTHQSFLPVGFPGALEETPFTFNPAKAKEILAKAGIKDPHFTLDVENKPPFITIAQSIQASFAQGGVKVDLLPAAGSQVYSRVRAHQHQGAIRMWLPDYFDAHSNASSFAYNDGKSSTVAGLNGWKIPELNKETLAAIAEPDSTKRLDLYKKMQQELQRSSPYVFIDQGKTQIVMRDNVQGYQQGLNADMVWFDQVTK

SEQ ID NO: 547 - protein, 148 aa, Escherichia coli
MFQPLSVNDAHNGVAFRMLQGVVPQTVIMNRHGITLRATGMMTVRHQTGSNAGGFRAHFSTVTVHGIEQYPCLVIIVIRFGCHKCPAVVQGVQIPDTTAVVFAKMVHPAEDTGFQGHPLWNEAKMLRPEADALFMRNESGNQLRLVIL

SEQ ID NO: 548 - protein, 161 aa, Escherichia coli
MKTVSQNTCTLSASVVTASENDQPQLVATLVPHEQRISFWPQHFGLIPQWVTLEPRVFGWMDHLCEDYCGGIWNLYTLNNGGAFMAPEPDDDDDETWVLFNAMNGNRAEMSPEAAGIAACLMTYSHHACRTECYAMTVHYYRLRDYALQHPECNAIMRIID

SEQ ID NO: 549 - protein, 260 aa, Escherichia coli
MLNRKLNIRLRHSLNSHCIPSIIINNTVRSFQRSVMNTRALFPLLFTVASFSASAGNWAVKNGWCQTMTEDGQALVMLKNGTIGITGLMQGCPNGVQTLLGSRISINGNLIPTSQMCNQQTGFRAVEVEVGQAPEMVKKAVHSIAERDVSVLQAFGVRMEFTRGDMLKVCPKFVTSLAGFSPKQTPAINKDSVLQAARQAYAREYDEETTETADFGSYEVKGNKVEFEVFNPEDRAYDKVTVTVGADGNATGASVEFIGK

SEQ ID NO: 550 - protein, 291 aa, Escherichia coli
MIFLLIPLHIQLTCDGENHQKRKRLRRNQMKQYKGGYNVNRYDWKNKTTEHLLNDNNLADNHIPEWIRKNEIAAFWFWLIMSHTVPEKLKLNNESEFNSALKGVIVMKDNPMTIIPSSHETRLNVIGKWINALILYGEADRIISIMHQNWLGLEKRNEAKWLKKNTEQLKWAWEYIDARISPTYLSWFNPVNDNERYIAIVVLLKMLFPTDTPCLLTPKEFHLGFAAKERFFDKMHNAFRKQFIDGKKDKRVQINVKISPSAKSALDRLTRERKTTQQAILEQLILYGRLD

SEQ ID NO: 551 - protein, 60 aa, Escherichia coli
MFQNSLLCCFPLSGQSVQSAFCGWRYLYVDLYPFIFFSIDKLFSECIVHLVEKSFFCSES

SEQ ID NO: 552 - protein, 225 aa, Escherichia coli
MMPLLDKLREQYGVGPLCSELHIAPSTYYHCQQQRHHPDKRSARAQRDDWLKKEIQRVYDENHKVYGVRKVWRQLLREGIRVARCTVARLMAVMGLAGVLRGKKVRTTISRKAVAAGDRVNRQFVAERPDQLWVADFTYVSTWRGFVYVAFIIDVFAGYIVGWRVSSSMETTFVLDALEQALWARRPSGTVHHSDKGSQYVSLAYTQRLKEAGLLASTGSNRRLV

SEQ ID NO: 553 - protein, 78 aa, Escherichia coli
MINWPWCFFSVQGDYLYHKALFRKSVMIGSGVLIQMRFTLSMVNRFYGVLKSNVFRIRKSILILVNFVLVAELSVNRF

SEQ ID NO: 554 - protein, 88 aa, Escherichia coli
MVLLLICIARKRSGCVSGVLFECSVDPFPFRLFSSSMSFLNPFMLLLRVLLLCAGLSFRSGMVCSVSITLNQRVVALLNAGCRKVLPR

SEQ ID NO: 555 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 556 - protein, 295 aa, Escherichia coli
MPLLDKLREQYGVGPVCSELHIAPSTYYHCQQQRHHPDKRSARAQRDDWLKREIQRVYDENHQVYGVRKVWRQLLREGIRVARCTVARLMAVMGLAGVLRGKKVRTTISRKAVAAGDRVNRQFVAERPDQLWVADFTYVSTWRGFVYVAFIIDVFAGYIVGWRVSSSMETTFVLDALEQALWARRPSGTVHHSDKGSQYVSLAYTQRLKEAGLLASTGSTGDSYDNAMAESINGLYKAEVIHRKSWKNRAEVELATLTWVDWYNNRRLLERLGHTPPAEAEKAYYASIGNDDLAA

SEQ ID NO: 557 - protein, 336 aa, Escherichia coli
MKKWFPALLFSLCVSGESSAWNNIVFYSLGNVNSYQGGNVVITQRPQFITSWRPGIATVTWNQCNGPEFADGSWAYYREYIAWVVFPKKVMTQNGYPLFIEVHNKGSWSEENTGDNDSYFFLKGYKWDERAFDAGNLCQKPGETTRLTEKFDDIIFKVALPADLPLGDYSVKIPYTSGMQRHFASYLGARFKIPYNVAKTLPRENEMLFLFKNIGGCRPSAQSLEIKHGDLSINSANNHYAAQTLSVSCDVPANIRFMLLRNTTPTYSHGKKFSVGLGHGWDSIVSVNGVDTGETTMRWYKAGTQNLTIGSRLYGESSKIQPGVLSGSATLLMILP

SEQ ID NO: 558 - protein, 176 aa, Escherichia coli; identical to SEQ ID NO: 365

SEQ ID NO: 559 - protein, 179 aa, Escherichia coli; identical to SEQ ID NO: 366

SEQ ID NO: 560 - protein, 179 aa, Escherichia coli; identical to SEQ ID NO: 367

SEQ ID NO: 561 - protein, 193 aa, Escherichia coli; identical to SEQ ID NO: 368

SEQ ID NO: 562 - protein, 244 aa, Escherichia coli
MWKLSMIRKKILMAAIPLFVISGADAAVSLDRTRAVFDGSEKSMTLDISNDNKQLPYLAQAWIENENQEKIIAGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 563 - protein, 843 aa, Escherichia coli
MNLVMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 564 - protein, 195 aa, Escherichia coli; identical to SEQ ID NO: 370

SEQ ID NO: 565 - protein, 198 aa, Escherichia coli
MCSVMKKRLLFMIKSVIAGAVAMAVVSFGANAAASIPQGQGEVSFKGTVVDAPCGIETQSAKQEIDFGQISKSFLQEGGETQPKDLNIKLVNCDITNFKQLQGGAAKKGTVSLTFSGVPAENADDMLQTVGDTNTAIVVTDSSGKRVKFDGATETGASNLINGDNTIHFTAFVKKDNSGKNVAEGAFSAVANFNLTYQ

SEQ ID NO: 566 - protein, 148 aa, Escherichia coli
MNVNVASTRGRAGFHNTSAGILHIASVLALQHVSCCCPPGFLDSLLHPLLHLTFVPAAAAPQFDGFREMTFTDQLVKPFICHASETGDVVHVDQGIVGTQQYAVVACCGQHGQNVLCEIYEGWANAGESTERSFQSWPATGYQGLPAR

SEQ ID NO: 567 - protein, 454 aa, Escherichia coli
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAALVILNGLFQGMGVGPSFITIANWFPRRERGRVGAFWNISHNIGGGIVAPIVGAAFALLGSEHWQSASYIVPACVAIVFAVIVLILGKGSPHQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 568 - protein, 435 aa, Escherichia coli
MSQCDFCGVLIFMTWITNRFFSWCEIGIKTMILLLLLMDVGAVRAQRNELVMATTFSPGAIAWIIQRWQTEPESVMIRTLNRTSASLEQLLDTANVENVDLILTSSPMLLQHLQEHQKLAPFDDAPAESQNLVPESIRATSVAVAISGFGLLINRPALSVKHLPAPADWDDLALPIYQDALLMSSPSRSDTNHLMVESLLQQKGWVKGWETLLTSAGNLVTISSRSFGVADKIKSGLGVAGPVIDNYANLLLNDPHISFTYFPRSAVSPTYVAILRKSPHADAARRFIHYLLSPKGQRILADANTGKYPVTSLAADNPRATQQQLLMNQPPLNYHLILKRQRLVQRLFDTAISFRFAQLKDAWRALHSTEARLKKPLPEIRALLTQMPVAAASSEDPVWLAQFDNKSFAEQQMMEWQLWFLNNQRLAIKKLEELK

SEQ ID NO: 569 - protein, 669 aa, Escherichia coli
MKNITLWQRLRQVSISTSLRCAFLMGALLTLIVSSVSLYSWHEQSSQIRYSLDKYFPRIHSAFLIEGNLNLVVDQLNEFLQAPNTTVRLQLRTQIIQHLDTIERLSRGLSSRERQQLTVILQDSRSLLSELDRALYNMFLLREKVSELSARIDWLHDDFTTELNSLVQDFTWQQGTLLDQIASRQGDTAQYLKRSREVQNEQQQVYTLARIENQIVDDLRDRLNELKSGRDDDIQVETHLRYFENLKKTADENIRMLDDWPGTITLRQTIDELLDMGIVKNKMPDTMREYVAAQKALEDASRTREATQGRFRTLLEAQLGSTHQQMQMFNQRMEQIVHVSGGLILVATALALLLAWVFNHYFIRSRLVKRFTLLNQAVVQIGLGGTETTIPVYGNDELGRIAGLLRHTLGQLNVQKQQLEQEITDRKVIEADLRATQDELIQTAKLAVVGQTMTTLAHEINQPLNALSMYLFTARRAIEQTQKEQASMMLGKAEGVISRIDAIIRSLRQFTRRAELETSLHAVDLAQMFSAAWELLAMRHRSLQATLVLPQGTATVSGDEVRTQQVLVNVLANALDVCGQGAVITVNWQMQGKTLNVFIGDNGPGWPEALLPSLLKPFTTSKEVGLGIGLSICVSLMEQMKGELRLASTMTRNACVVLQFRLTDVEDAK

SEQ ID NO: 570 - protein, 217 aa, Escherichia coli
MANMNGKYNVRSELLARCIGTGRLKGDVVSDFIGFNGSKQIGYVLLTLFLIKVINPDLLSHYRIFNRFLRYERKVMDIYNSLSDIEVDCICREVMAIYEHTQRCCNEKKITTVQLGRKLNGRYADMIAELKETAEMRGEGVISFEMDILNSFNDANEYHGRVKLELDIPASDILYCHDFIDSEHVNSWLVEPHEWVVINRSLTGIVTVPVSAIKISY

SEQ ID NO: 571 - protein, 296 aa, Escherichia coli
MMPLLDKLREQYGVGPLCSELHIAPSTYYHCQQQRHHPDKRSARAQRDDWLKKEIQRVYDENHQVYGVRKVWRQLLREGIRVARCTVARLMAVMGLAGVLRGKKVRTTVSRKTVATGDRVNRQFVAERPDQLWVADFTYVSTWQGFVYVAFIIDVFAGYIVGWRVSSSMETTFVLDALEQALWARRPSGTVHHSDKGSQYVSLAYTQRLKEAGLLASTGSTGDSYDNAMAESINGLYKAEVIHRKSWKNRAEVELATLTWVDWYNNRRLLGRLGHTPPAEAEKAYYASIGNNDLAA

SEQ ID NO: 572 - protein, 55 aa, Escherichia coli
MSDIFVISGFAFSGHDRPLPCHTSCVKNTASQRGGSHKHSCCGIVINNFSLNAGI

SEQ ID NO: 573 - protein, 222 aa, Escherichia coli
MFGQHIRSLAPQFGDGTFELTRGFNRRSGITDAATSDKHMNRNAFEQRQIFQRQATSNGDFEAHIGKTFDRGNVSFAPRHACGLCVTAAVINHLLNACIAPLLRLFPGPVTGQFDLHVAVKLFCHVQRTFGGVDIRTANHGHPVSVSFEAHTRKDFARIGNFGVCQYDFVRVKRFQVTNRTHAFAHAQNGAHFDNVDFFGNQASGFVGAIHSLVVQRDLQHW

SEQ ID NO: 574 - protein, 203 aa, Escherichia coli
MVVNALAVGCGLNVAPAQAHKFASNYHCFMVRRFDRTNAGRRLHFASAMTLTRHQDGEDASTGVSYLELADVLIRHGAQTNTDLKELWSRIVFNILVSNTDDHLRNHGYILIPGKGWRLSEAYDLNPVARSDGLKLNITENDNALDLELAREVAEYFRLGLTEADDIIANFRGIVSQWRIIAERLRLPGREQELMAEAFRGAI

SEQ ID NO: 575 - protein, 425 aa, Escherichia coli
MNKIKNYRWHMIALVCFITVINYLDRTALGIAAPTIMETTGITKEQYSWIVSAFQLAYTLGQPIMGFFIDTVGLKLSFAICAAIWGLATMGHALTGTWSGLAFMRALMGFSEASAIPAGVKTASTWFPAKERGVATGVFNMGTSLGAMLAPPLIAWCIMFHSWQFAFIVSGSLALLAALFWFFCYKDPKDAKRLSDEERHYIESGQEQHLKTDKKEKTSIKHILSQRNFWGIGIARFLADPAWGTINFWVPIFFVETLHFSLKEIAMFVWLPFLLGDLGCLASGFVAKFFHDRGVSLINSRRITFTIAAVIMMTIGLVSIVENPYIAVLLISIGAFSHQCLSTVAATLGGDLFKKDEVATAVGMAGACAWSGQLIFNLFIGAFVHIIGFAPFFIALAFFDIIGAIALWMLIKVKDEEPQVQLATS

SEQ ID NO: 576 - protein, 263 aa, Escherichia coli
MKSTRPVAVITGAARGIGKGCALELARGGFNLLINDRPDADSVEKLHATQQECLAEGVEVICFPADVGDLSLHEEMLDAAQNQWGRLDCLLNNAGISVKKRGDLLDLEPDSFDQNIAINTRAPFFLAQAFSKRLLAQPKPEAELPHRSIIFVSSINAIMLAMNRGEYTIAKTAVSAAARLFAARLCNEQIGVYEVRPGLIKTDMTIPATAYYDELIAKGLVPWGRWGYPADIASTVRAMAEGKLIYTCGQAVAIDGGLSMPRF

SEQ ID NO: 577 - protein, 490 aa, Escherichia coli
MKKSLLAVMLTGLFALVSLPALGNVNLEQLKQKAESGEAKAQLELGYRYFQGNETTKDLTQAMDWFRRAAEQGYTPAEYVLGLRYMNGEGVPQDYAQAVIWYKKAALKGLPQAQQNLGVMYHEGNGVKVDKAESVKWFRLAAEQGRDSGQQSMGDAYFEGDGVTRDYVMAREWYSKAAEQGNVWSCNQLGYMYSRGLGVERNDAISAQWYRKSATSGDELGQLHLADMYYFGIGVTQDYTQSRVLFSQSAEQGNSIAQFRLGYILEQGLAGAKEPLKALEWYRKSAEQGNSDGQYYLAHLYDKGAEGVAKNREQAISWYTKSAEQGDATAQANLGAIYFRLGSEEEHKKAVEWFRKAAAKGEKAAQFNLGNALLQGKGVKKDEQQAAIWMRKAAEQGLSAAQVQLGEIYYYGLGVERDYVQAWAWFDTASTNDMNLFGTENRNITEKKLTAKQLQQAELLSQQYIEKYAPEAWARMQKLKAQSAVKTGNK

SEQ ID NO: 578 - protein, 136 aa, Escherichia coli
MSKPWRKSFISGLSGDLPSSFGGVAFCASSAAARILVNASLTCTALSAFSTTFKLSLRVSILSSRSAANDAELNTNEETARIANRLLRIAHFLFYLHFILHTASSTATLIRPSHVLRVRSPALIHFPSRCSANDFV

SEQ ID NO: 579 - protein, 482 aa, Escherichia coli
MRRRVAYARDYGDHIMGKFKFPTAYTILFVLIALVAAMTWIVPAGKYQMVTNAALGKEVPVAGTYAPVEAQPQGITAVLLAPIDGLYNHQTYTAGAIDVALFVLIIGGFLGVVNKTGAIDAGIERVTTRLNGREEWMIPILMALFAAGGTIYGMAEESLPFYTLLVPVMMAARFDPLVAAATVLLGSGIGTLGSTINPFATVIAANAAGIPFTQGILLRVILLLVGYVICVYWVMRYARKVRNSPESSIVADKMAENQAHFLGNRSETMLEFTPTRKAILILFAASFAFMIYGVAVLGWWMAEISAVFLAAAVIVGVIARMGEETFTSTFIDGARDLLGVALIIGIARGIVVVMDNGMITHTILHSAENLVSGLSTTVFINVTYWLEVLLSFLVPSSSGLAVLTMPIMAPLADFAHVQRDLVVTAYQSASGVVNLITPTSAVVMGGLAIARVPWVRYLRWVAPLLLILTMLNMIVLSIAAMI

SEQ ID NO: 580 - protein, 310 aa, Escherichia coli
MENKPTLVIALGGNALLKRGEPLEAEIQRKNIDLAAKTIAQLTQHWRVVLVHGNGPQVGLLALQNSAYAHVAPYPLDILGAESQGMIGYMLQQALKNQLPQREISVLLTQVEVDANDPAFSNPTKYIGPIYDHAQTQVLQAEKGWVFKADGHSFRRVVPSPQPKRIVERDAIQTLIAHDHLVICNGGGGVPVVEKADGYHGIEAVIDKDLSAALLASQIHADALLILTDADAVYLDWGKPTQRPLAQVTPELLNEMQFDAGSMGPKVTACAKFVSQCRGIAGIGSLADGPEILAGDKGTLIRLDTPHNHA

SEQ ID NO: 581 - protein, 44 aa, Escherichia coli
MHYRILFLYHLSEPHQILLTSIINITAGVKVVTFSGRNKLNHCI

SEQ ID NO: 582 - protein, 176 aa, Escherichia coli
MNDVNIGKDNSRHSFVFTGKGGEYFLICLVNFLLTIITLGIYGPWALIKCRRYIYQHVTLKGQPFSYKGTGGAIFVSMLLIVVVYLLSISCFAGQHFALGLFLFALLICGIPCMAVKSLQYQANMTSLNDIRFGFNCSMMRAWWGYARTACSVGVSFLVRTVSYCASDDIDRRLIL

SEQ ID NO: 583 - protein, 229 aa, Escherichia coli
MTTSIGGLFFNLVALSLLSAIGLGVVHGITYSKWMPLLGNNATFGIHKFSIQVNVKECIKGCMLAILTMVPFIIVIGIMIAPVFQQLMMMTMLGGSDAGSEFVLQYYPQIMASYFLYFVAILVFASYLYVTLRNLFLNNLTLANGTIRFHSSVTAIGMLLRMLAVLMGSSITCGLAYPWLKMWMVSWIANNTHVQGDLDSLELTNDDKPQDSGSLMWISRGIMPYVPFI

SEQ ID NO: 584 - protein, 1023 aa, Escherichia coli
MKLKFKHQPYQAAAVQAVVDIFQGQPPASDAAMSYRLDPGNTKNGMGDLFAVDTGFKNAELTLSEVALLDNIQQVQRQQNLPLSESLVKTKVAKLNLDIEMETGTGKTYCYIKTVFELNKQYGWSKFVIVVPSIAIREGVAKSLEITAEHFQETYHKKARFFIYNSKQLHHLESFSSDAGINVMVINVQAFNATGKDNRRIYEALDDFQSRRPIDVISANRPILILDEPQRMEGGKTLDSLANFNPLMVLRYSATHKTTHNKIHRLDALDAYNQKLVKKIEVRGISVKGLAGTNAYLYLQSIEISNKKPPVAVVEFEQKLSGGNIKRVTRKLGKGDNLFVLSNELDQYRDGFVVSDINANTDTLSFTNGVELTVGDVIGDISEIALRRIQIRETIKAHFDKEMELFDKGVKVLSLFFIDEVARYRDYSAVDEKGEYAKIFEEEYAKHIQEVFDNGFMEGDAPYAKYLRRIAADKTHSGYFSIDKKSKRLTDPKAAARGENAGLSDDVDAYDLILKDKERLLSLAEPVRFIFSHSALREGWDNPNVFVICTLKHSDNTISRRQEVGRGLRLSVNQNGERMDHPSIVHDINVLTVVASESYKDFVTALQKDISDSLSARPRVADKAYFTGKMLNTKEGPITVSDDQATDIEFYLIQNGYVDKKRNITEKYHQAKKDGTLEALPDELQPYAEQVFQLINSVFSESQLMQVEDGRKPKRLQTNANFEKQEFKALWGRINRKATYSVLFDDVELVNNAIKALNDKNAGLRVTPLQYTIHRGKQADTATYDDLKKGIAFELKVTETESHTASIHSAVQYDLIGKLSEGTLLTRRTIAEILKGLHADVFAQFKSNPESFIAEVIRLVNEQKANVIIEHLAYDTLEDKFDLDIFTTGQSKQDLSKAGNKLQNHIYDYVLTDSAIERKFVEELDTSKDVVVYAKLPRGFLIPTPVGDYNPDWAISFKEGSVKHVYFVAETKGSMSSLDLRPIEATKIKCARKFFDAVNKTFAPENVKYDVVDSFSKLMEVVK

SEQ ID NO: 585 - protein, 114 aa, Escherichia coli
MKRHSGSQFKFVLVWLVALLPVLAKVQAQALECRWQAALAGHVQVGCRTGDADVQVFIEQRRVQSGELVNADKEHRLELHAFDVLDVEHAHVTFSSPSSSSTTTRAMAGSATST

SEQ ID NO: 586 - protein, 94 aa, Escherichia coli
MRHEIQLDDARPLDIIMRSFVGLWLLVEQCWFFDAGDDEIPKLSTLAIKGPYVPAQAGINQGKGHNYPLGLAAAHRVVADGDGSLSVDSSANRG

SEQ ID NO: 587 - protein, 43 aa, Escherichia coli
MLESKKRLVSDLLESIDIPGSEIITIMLANFLLFKPASEDILP

SEQ ID NO: 588 - protein, 135 aa, Escherichia coli
MQLILSIYHVICSVTSKINIKNSAKFNICSTSRLTYDIISQLHLPQNGYFMERSNFLVAIIMLMLRSLAIIPAWFVSLRHEIVTFLFQTVYFLEIWGNAGDAFSSTFVGKYGFGHCDLNLPQSQLFAGRYGKQTI

SEQ ID NO: 589 - protein, 42 aa, Escherichia coli
MATTLPLTVMVTSAACIVALANANIAANKYPRLRHFMSISSY

SEQ ID NO: 590 - protein, 43 aa, Escherichia coli
MFFCVCVLLEPGKFLELKNLISHVGMGKMQVCFLLCVFCIAEK

SEQ ID NO: 591 - protein, 306 aa, Escherichia coli
MTNFTTSTPHDALFKSFLTHSDTARDFMEIHLPKDLRELCDLDSLKLESASFVDEKLRALHSDILWSVKTREGDGYIYVVIEHQSREDIHMAFRLMRYSMAVMQRHIEHDKRRQLPLVIPMLFYHGSRSPYPWSLCWLDEFADPTTARKLYTAAFPLVDITVVPDDEIVQHRRVALLELIQKHIRQRDLMGLIDQLVVLLVTECANDSQITALLNYILLTGDEARFNEFISEITRRLPQQRERIMTIAERIHNDGYIKGEQRILRLFLQNGVDPEWIQKITGLSAEQIQALEQPLPEREPYSWLKS

SEQ ID NO: 592 - protein, 739 aa, Escherichia coli
MGYAGRMWCNGESPSRNDGIYMSPRQIRGYYCEIIASRKDVRMKATEARLLDFLKRSQQFVIPIYQRTYSWTEQQCRQLWDDIIRAGKRDDISAHFIGSVVYIEQGLYQVSGISPLLVIDGQQRLTTAMLLIEALSRHLGEDEVFDGFSAMKLRNYYLLNPYESGEKGFKLLLTETDKDSLLALIKQRPMPENYSHRIMENFTFFDEQIAKLGDDLIPLCRGLAKLLIVDVALNRGQDNPQLIFESMNSTGKALSQADLVRNFILMGLEPEHQTRLYEDHWRPMEVAFGQQGYSEYFDSFMRHYLTVKTGEIPRTDEVYEAFKLHARSQSVAEKGVDRLVEDIHIYAEYYCAMALGKESDKSLATAFQDLRELKVDVAYPFLLALYHDYKNGVLSHEDFLSIIRLIESYVFRRSVCAIPTNSLNKTFATFYKVINKEKYLESIQVHFLNLPSYRRFPNDDEFKRELKVRDLYNFRSRSYWLRRLENDKRRERVEEFTIEHIMPQNENLSAKWREELGSDWQRIHKELLHTLGNLTLTRYNSRYSDRPFAEKRDIEDGFKHSPLYLNIGLGQCEKWDEAAIHARADRLADLAVQVWQAPSLPEEVLAVYRGQPENKTSYSLSDYPFLADGSHSRVLFDHLRDEIMRLDAGITQEVLKLYIAFKAETNFVDVVPQKSRLRLSLNMQFHELVDPKGIAKDVTNVGRWGNGDVEIGFSDLAQLPYIMGLIRQAFEKQMESALV

SEQ ID NO: 593 - protein, 423 aa, Escherichia coli
MSWLLIIPLMIVCLFLNIRVYLAMFIGIIAYFLFFSSVPIEIAVQRLIAPTQSPSLLAIPFFILLGTLMSYTGIAERILHIANVLVGKMRGGLGVANILVSTMMGGVSASNLADAAMLSRMMVPEMERKGYNRAFAAAITAGGSLVTPIIPPGIALIIYGLVADVSIGKMFIAGLVPGLLCAVVLMFTVYLVARKTNAKPSRESWPTGKEVVFSLGQAWPALFLIFAVVGGIRANIFTPTEAGAVAVLIVLAIGFFIYREMRISHVVKALGETARATASVMLVIMASAALGWIFSMEHAGVAVANFVTSLTENKYMFLLIINILLLTLGMFLEGNAILLILVPLLKPVVEHFGIDPVHFGIIMIFNLSIGAFTPPVGTVMLLVCNITQVSVGNFFKQSLPLLAALLLMLMLVTYIPAISLFLV

SEQ ID NO: 594 - protein, 157 aa, Escherichia coli
MRLFGKVAEFSAAFALFVLVVVTIGAVFMRYFIGQPLQWTEEMSGMLMIWVVMLGGVVAERDRAHLTIPFLMEMLPGKLRRVIAVLVALLSIALLLYMAWLGYRLAEMAQFKVTQILKVSWFWIDLAVPVGALATAIYTLYWLINDTKQSDSGDKMQ

SEQ ID NO: 595 - protein, 54 aa, Escherichia coli
MSKIIAMLITVSTLFLPSIIQAKPISIKVAYENNPGEPLDVVMPLLGRPIKQKK

SEQ ID NO: 596 - protein, 557 aa, Escherichia coli
MRKPVYYMEILLTILILTLVVSLTSVLTRLSPVQIPLPLIQIAAGAVLAQPIFGLHVEFNPELFLLLFIPPLLFAESSKIQPKELIKHSREIISLALVLVLITIFGVGYVIHLLLPNVPLIAAFALAAVLSPTDAVALLGIVGKGRISKNIQEVLEGEALMNDASGLVALKFAVAVTMGTMEFSVHGATIAFFVVALGGIAVGIAVTWLYGKGLLLISRYAHDEPSIQIVLMLLLPFIVYLVAEHFGLSGILAAVAAGLTTSRIGVVHHAPIRLRIKAKSSWSMLEYVFNGMVFLILGLQLPGIISESLIRAENDPLVDTGSLLLDVIWIYLALMVVRLGWLWLMRLYSRKRPGKHPMLFAGYKTRHMLLATFAGVRGAITLAGVLSIPLLLPDGTPFPGRYLLVFLATGVILFSLVCGIIILPLLLGKNVGIFSDNRQKEEEAADLFMAKMAILSVQKTEQRLLRARTENLDNELIMETGARVIGYMRHSEEDMSPNDNSLHMQRAKLERTFNLAALNAKRAAIYQMRARQEVSDETLAKIVSELDVLETLIMDSR

SEQ ID NO: 597 - protein, 1042 aa, Escherichia coli
MLMKRHLNTCYRLVWNHITGAFVVASELARARGKRGGVAVALSLAAVTPLPVLSADIVVHPGETVNGGTLVNHDNQFVSGTANGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVAGKADNVVLENGGRLDVLSGHTATNTRVDDGGTLDIRNGGAATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASDATWNIPDNATVQSVVDDLSHAGQIHFTSSRTGTFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRILAGSRSHQTGVNGENNSVRLSIQGGHLGHDNNGGIARGATPESSGSYGFVRLEGDLLRTDVAGMSVTAGIYGAAGHSSVDVKDDDGSRAGTVRDDAGSLGGYMNLTHTSSGLWADIVAQGTRHSMKASSGNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 598 - protein, 342 aa, Escherichia coli
MSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 599 - protein, 759 aa, Escherichia coli
MAQRQPEKTAAGGCCFNSLYNKYSGITMMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

What is claimed:

1. A method for raising an immune response in a subject, comprising the step of administering to the subject a pharmaceutical composition comprising a pharmaceutically acceptable carrier in admixture with (a) an amino acid sequence that is the full-length amino acid sequence set forth in SEQ ID NO: 577; (b) an amino acid sequence that is at least 90% identical to the full-length amino acid sequence set forth in SEQ ID NO: 577; (c) an amino acid sequence which is a fragment of at least 10 consecutive amino acids from SEQ ID NO: 577; or (d) an amino acid sequence that is at least 90% identical to the full-length amino acid sequence set forth in SEQ ID NO: 577 and includes a fragment of at least 10 consecutive amino acids from SEQ ID NO: 577.

2. The method of claim 1, wherein the pharmaceutical composition further comprises an adjuvant.

3. The method of claim 1, wherein the pharmaceutically acceptable carrier is in admixture with (b).

4. The method of claim 3, wherein the amino acid sequence is at least 95% identical to the full-length amino acid sequence set forth in SEQ ID NO: 577.

5. The method of claim 1, wherein the pharmaceutically acceptable carrier is in admixture with (c).

6. The method of claim 5, wherein the amino acid sequence is a fragment of at least 16 consecutive amino acids from SEQ ID NO: 577.

7. The method of claim 1, wherein the pharmaceutically acceptable carrier is in admixture with (d).

8. The method of claim 7, wherein the amino acid sequence is at least 95% identical to the full-length amino acid sequence set forth in SEQ ID NO: 577 and includes a fragment of at least 16 consecutive amino acids from SEQ ID NO: 577.

\* \* \* \* \*